United States Patent 11,141,476 (MERS CORONAVIRUS VACCINE) - sequence listing, part 2

SEQ ID NO: 943 - RNA, 4062 nt, Artificial Sequence
  derived and/or modified CDS sequence (opt5) from MERS-CoV__AKN11074__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcacagugccgucuaccgucugggaggacggggauuacuaccgcaaacagcuguccccucuggaaggaggcggguggcucguggcuagcggauccacaguugccaugaccgagcagcugcagaugggcuuugggauuacggugcaauauggcaccgacacaaacucugucugccccaaacuugaguucgcgaaugauaccaagaucgcuagccagcugggaaacuguguggaauacucccucuauggcgugucugggagaggaguuuuucagaauugcacagccgucggcgugcggcagcaacauuucguguacgacgccuaucagaaccuggucggguacuauagcgaugacggaaacuacuacugucugagagcuugcguguccguuccugugucugucauuuaugauaaggagaccaagacgcacgccacacuuuuuggcagcguggcuugugaacacaucuccagcaccaugucucaguacucccgcagcacacggucuaugcucaaaagacgcgacuccaccuaugggccccugcagaccccuguuggcugcgugcugggacucgucaauagcucucuguucguggaggauuguaaacuuccccugggccaaucccucugcgcccugccggacacaccuagcacgcugacaccccgguccguuagaagcgugcccggggaaaugcgccuugcgucuauugccuuuaaccauccuauccaggucgaucagcucaauagcuccuacuucaagcugucuauuccgaccaacuuuagcuucggagugacccaagaguauauccagacaaccauccagaaggugacggucgacuguaaacaguacguuugcaauggcuuccaaaagugcgaacagcugcuccgggaguaugggcaguuuuguuccaagauuaaccaggcucugcacggagccaaucuuagacaagaugacucugugcgcaaccuguucgcuagcgugaaauccucucagagcucccccaucauuccuggcuuugggggcgacuucaaucucacacugcuggagcccgucagcaucucuaccggaucccggagcgccagaucugcgauugaagaucuucucuuugacaaggugaccaucgccgauccuggcuacaugcagggguacgacgauugcaugcagcaaggacccgcuuccgcccgcgaccugaucugugcucaguauguugccggcuacaaagugcugccuccccucauggaugucaacauggaggccgcuuauacaagcucccugcuugggucuauugcgggagugggcuggaccgccgggcugagcuccuucgcugccaucccguuugcccagagcauuuucuaccggcucaauggcguuggaaucacacaacaggugcugucugaaaaccagaagcugauugcuaauaaauuuaaccaggcccuuggcgcgaugcaaacgggguucaccacaaccaaugaggcuuuuagaaagguccaggacgccgugaacaacaaugcccaggcucucuccaagcuggccagcgaacugucuaacacauucggagcgaucagcgcuuccaucggcgauauuauccagcggcucgacguucuggagcaagaugcccagauugaccgccuuaucaaugggagacugaccacgcucaacgccuucguggcucagcagcugguccggucugagagcgccgcucuguccgcccaacuugcgaaagauaaggugaaugaaugcgugaaagcccagucuaagagaagcggauuuuguggccagggcacccauauugucuccuucguugugaacgcuccuaaugggcuguauuuuaugcacgugggauacuaucccagcaaccauaucgaggucgugucugccuacggccucugcgacgcugccaauccuacaaacuguaucgcccccguuaauggguacuucauuaaaaccaacaauacacgcaucguggacgaaugguccuauaccggaagcuccuuuuacgcuccggagccuauuacaucucugaacaccaaguaugucgcgccccaggugacguaccaaaauaucagcacaaaccucccuccuccccugcuuggcaacuccaccgggauugauuuccaggacgagcuggaugaauuuuucaagaauguuucuaccagcauccccaacuuuggaucccucacacagauuaauaccacgcugcuggaccuuacauaugagaugcugagccuccaacagguggucaaagcccugaacgaaucuuacaucgaucucaaggagcugggcaauuauaccuacuacaacaaauggccgugguauaucuggcuuggcuucauugcugggcugguggcccucgcccugugcgucuuuuucauccuguguugcacaggauguggcaccaauugcauggggaaacuuaagugcaaccgguguugcgacagauacgaagaguaugaucuggagccccacaaggugcacguucauuga

SEQ ID NO: 944 - RNA, 4062 nt, Artificial Sequence
  derived and/or modified CDS sequence (opt5) from MERS-CoV__AKN24803__S
auggugcacagcgucuuccugcucauguuucugcuuacccccacagaguccuacguugacgugggcccugauucugugaaguccgccugcaucgaagucgacauucagcaaacguucuuugauaaaaccuggccgagacccaucgacguguccaaggcugaugggauuaucuauccucagggacggacauacucuaacauuaccaucacauaucagggccuguuccccuaccagggggaccauggagauauguauguuuacagcgccggccacgcgaccgggacaaccccucaaaaacucuuuguggcuaauuauucccaggacgucaagcaguucgccaacggauuugugguucgcaucggcgccgcugccaauucuacgggcaccgugauuaucagccccuccacaagcgcuaccauuagaaaaaucuacccugccuucaugcuggggucuuccgucggaaacuuuagcgauggcaagauggggcgguucuuuaaucauacacuugugcugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauucuggagugguucggcaucacgcagaccgcccaaggggugcaccucuuuuccucuagauaugucgaccuguacggaggcaauauguuccaguuugcgacacuuccuguuuacgacaccaucaaauauuacagcauuaucccccacuccauucggagcauccagucugaucgcaaggccugggcugccuucuauguguacaaacugcagccgcucacauuucugcuggacuucuccguggauggguauauuagacgggcuaucgacugcggauuuaacgaucucagccaacugcauuguucuuacgagagcuucgacgucgaauccggcguguauucuguuagcuccuuugaggccaagccuagcgggucuguggucgaacaggccgagggaguggagugcgauuucagcccccuucugagcggcaccccuccccagguuuacaacuuuaaacgccucguguucacgaauuguaacuacaauuucacaaagcugcuuucucuguuuuccgucaacgacuuuaccugcagccaaaucucccccgcugcgauugccucuaauuguuauagcucccucauccuggauuacuuuucuuauccucugagcaugaaguccgaccucagcgugucuuccgcuggcccgauuagccaguucaacuacaaacagucuuuuuccaauccuaccugccugauccuugccacagucccccacaaccugaccacaauuacgaagccccucaaauauagcuacaucaauaagugcucuagacugcuuagcgaugaccggaccgaagugccucagcugguuaacgccaaucaauauucccccugugugagcaucgucccgucuacagugugggaggacggggauuacuaccgcaaacagcucuccccucuggaaggaggcggguggcugguugcuagcggauccaccguggccaugacagagcagcuccagaugggcuucgggauuaccguccaauauggcacggacaccaacucugugagccccaagcuggaauuugcgaaugauacaaaaaucgcuucccagcuuggaaacugcguggaguacucucuguauggcguuagcgggagaggagucuuccagaauuguaccgccgugggcgugcggcagcaaagauuugucuacgacgccuaucagaaccucgugggguacuauuccgaugacggaaacuacuacugccugcgcgcuuguguuucugugccugucagcgugauuuaugauaaggagacaaagacccaugccacgcuguucggcuccguugcuugcgaacacaucagcucuacaaugucccaguacagccggucuaccagauccaugcuuaaacgccgggacagcacauaugggccccuccagaccccugugggcuguguccugggacugguuaauucuucccucuuuguggaggauugcaagcugccccuuggccaaagccugugugcccucccggacaccccuuccacacugacgcccagaagcgugcgcucuguccccggggaaaugcggcuggcgagcauugccuucaaccacccuauccagguggaucagcuuaauuccucuuacuuuaaacucagcauuccgaccaacuucuccuucggagugacacaagaguauauccagaccacaauccagaaggucaccguugacugcaaacaguacguguguaauggcuuucaaaagugcgaacagcugcugagagaguaugggcaguucugcucuaagauuaaccaggcucuccauggagccaaucugcgccaagaugacagcgugcggaaccuuuuugcuuccgucaaaucuagccaguccagccccaucauuccuggcuucgggggcgacuuuaaucugacgcuccuggagcccgugucuaucuccacaggaagcagaucugcccgcuccgcgauugaagaucugcuuuucgacaagguuaccaucgccgauccuggcuacaugcagggguacgacgauuguaugcagcaaggacccgcuagcgcccgggaccucaucugcgcucaguauguggccggcuacaaaguccugccuccccugauggaugugaacauggaggccgcuuauaccuccucucuccuggggagcauugcgggaguuggcuggacagccgggcuuuccagcuuugcugccaucccguucgcccagucuauuuucuacagacugaauggcgugggaaucacccaacagguccucuccgaaaaccagaagcugauugcuaauaaauucaaccaggcccugggcgcgaugcaaacaggguuuacgaccacaaaugaggcuuuccggaaggugcaggacgccguuaacaacaaugcccaggcucuuagcaagcucgccucugaacugagcaacaccuucggagcgaucuccgcuucuaucggcgauauuauccagcgccuggacgugcucgagcaagaugcccagauugacagacugaucaaugggcggcuuacaacccugaacgccuuugucgcucagcagcucgugagaagcgaguccgccgcucugucugcccaacuggcgaaagauaaggugaaugaaugugucaaagcccagagcaagcgcuccggauucugcggccagggcacgcacauuguuagcuuuguggugaacgcuccuaaugggcuuuauuucaugcaugucggauacuaucccucuaaccacaucgaggugguuuccgccuacggccugugugacgcugccaauccuaccaacugcaucgcccccgugaauggguacuuuauuaaaacaaacaauacccggaucgucgacgaauggagcuauacaggauccucuuucuacgcuccggagccuauuaccagccucaacacaaaguauguggcgccccagguuaccuaccaaaauaucuccacgaaccugccuccuccccuccugggcaacucuacagggauugauuuucaggacgagcuugaugaguucuuuaagaaugugagcaccuccauccccaacuucggaagccugacccagauuaauacaacccuccuggaccugacguaugaaaugcuuucucugcaacaggucgugaaagcccucaacgaauccuacaucgaucugaaggagcucggcaauuauacauacuacaacaaauggccgugguauaucuggcugggcuuuauugcugggcuugucgcccuggcccucuguguguucuuuauccugugcuguaccggaugcggcacaaauuguauggggaagcugaaaugcaacagaugcugugaccgcuacgaagaguaugaucuugagccccauaagguucacgugcacuga

SEQ ID NO: 945 - RNA, 4062 nt, Artificial Sequence
  derived and/or modified CDS sequence (opt5) from MERS-CoV__AKN24812__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucugcguuuauaaacugcagccgcucacauuucugcuggacuucuccguggauggguacaucagacgggcuaucgacuguggauuuaacgaucucagccaacugcauugcucuuaugagagcuucgacguggaauccggcgucuacucugugagcuccuuugaggccaagccuagcgggucuguuguggaacaggccgagggagucgagugugauuucagcccccuucugagcggcaccccuccccagguguauaacuuuaaacgccucguuuucacgaauugcaacuacaauuucacaaagcugcuuucucuguuuuccgugaacgacuucaccuguagccaaauuucccccgcugcgaucgccucuaauugcuacagcucccucauucuggauuauuuuucuuacccucugagcaugaaguccgaccucagcgucucuuccgcuggcccgaucagccaguucaacuauaaacagucuuuuuccaauccuaccugccugauucuugccacagugccccacaaccugaccacaaucacgaagccccucaaauacagcuauaucaauaaguguucuagacugcuuagcgaugaccggaccgaagucccucagcuggugaacgccaaucaauacucccccugcguuagcauugugccgucuacagucugggaggacggggauuauuaccgcaaacagcucuccccucuggaaggaggcggguggcugguggcuagcggauccaccguugccaugacagagcagcuccagaugggcuucgggaucaccgugcaauacggcacggacaccaacucugucugucccaagcuggaauuugcgaaugauacaaaaauugcuagccagcuuggaaacugcguggaguauucccuguacggcgugucugggagaggaguuuuccagaauuguaccgccgucggcgugcggcagcaaagauuuguguaugacgccuaccagaaccucgucggguauuacagcgaugacggaaacuauuacugccugcgcgcuuguguguccguuccugugucugucaucuacgauaaggagacaaagacccaugccacgcuguucggcagcguggcuugcgaacacauuuccagcacaaugucucaguauucccggagcaccagaucuaugcuuaaacgccgggacuccacauacgggccccuccagaccccuguuggcugugugcugggacuggucaauagcucucucuuuguggaggauugcaagcugccccuuggccaaucccugugugcccucccggacaccccuagcacacugacgcccugcuccguuagaagcgugcccggggaaaugcgccuggcgucuaucgccuucaaccacccuauucaggucgaucagcuuaauagcuccuauuuuaaacucucuaucccgaccaacuucagcuucggagugacacaagaguacauccagaccacaauucagaaggugaccgucgacugcaaacaguauguuuguaauggcuuucaaaagugcgaacagcugcugcgggaguacgggcaguucuguuccaagaucaaccaggcucuccauggagccaaucugagacaagaugacucugugcgcaaccuuuuugcuagcgugaaauccucucagagcucccccauuaucccuggcuucgggggcgacuuuaaucugacgcuccuggagcccgucagcauuucuacaggaucccggagcgccagaucugcgaucgaagaucugcuuuucgacaaggugaccaucgccgauccuggcuauaugcagggguacgacgauugcaugcagcaaggacccgcuuccgcccgcgaccucauuugugcucaguacguugccggcuauaaagugcugccuccccugauggaugucaacauggaggccgcuuacaccagcucccuccuggggucuaucgcgggagugggcuggacagccgggcuuagcuccuuugcugccauuccguucgcccagagcaucuuuuaucggcugaauggcguuggaauuacccaacaggugcucucugaaaaccagaagcugaucgcuaauaaauucaaccaggcccugggcgcgaugcaaacaggguuuacgaccacaaaugaggcuuucagaaagguccaggacgccgugaacaacaaugcccaggcucuuuccaagcucgccagcgaacugucuaacaccuucggagcgaucagcgcuuccauuggcgauaucauucagcggcuggacguucucgagcaagaugcccagaucgaccgccugauuaaugggagacuuacaacccugaacgccuuuguggcucagcagcucguccggucugagagcgccgcucuguccgcccaacuggcgaaagauaaggugaaugaaugcgugaaagcccagucuaagagaagcggauucuguggccagggcacgcacaucgucuccuuuguugugaacgcuccuaaugggcuuuacuucaugcaugugggauauuaccccagcaaccacaucgaggucgugucugccuauggccugugcgacgcugccaauccuaccaacuguauugcccccguuaauggguacuuuaucaaaacaaacaauacccgcauuguggacgaaugguccuacacaggaagcuccuucuaugcuccggagccuaucaccucucucaacacaaaguacgucgcgccccaggugaccuaucaaaauauuagcacgaaccugccuccuccccuccugggcaacuccacagggaucgauuuucaggacgagcuugaugaguucuuuaagaauguuucuaccagcauucccaacuucggaucccugacccagaucaauacaacccuccuggaccugacguacgaaaugcuuagccugcaacagguggucaaagcccucaacgaaucuuauaucgaucugaaggagcucggcaauuacacauauuacaacaaauggccgugguacauuuggcugggcuuuaucgcugggcuuguggcccuggcccucugcgucuucuuuauucuguguugcaccggaugcggcacaaauuguauggggaagcugaaauccaaccggugcugugacagauaugaagaguacgaucuugagccccauaaggugcacguucacuga

SEQ ID NO: 946 - RNA, 4062 nt, Artificial Sequence
  derived and/or modified CDS sequence (opt5) from MERS-CoV__AKN24830__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggacccaccguugccaugacagagcagcuccagaugggcuucgggaucaccgugcaauauggcacggacaccaacuccgucugcccuaagcuggaauuugcgaaugauacaaaaauugcuucucagcuuggaaacuguguggaguacagccuguauggcguguccgggagaggaguuuuccagaauugcaccgccgucggcgugcggcagcaaagauuuguguacgacgccuaucagaaccucgucggguacuauucugaugacggaaacuacuacugucugcgcgcuugcgugagcguucccguguccgucaucuaugauaaggagacaaagacccaugccacgcuguucggcucuguggcuugugaacacauuagcuccacaaugagccaguacucucgguccaccagaagcaugcuuaaacgccgggacucuacauaugggccucuccagacccccguuggcugcgugcugggacuggucaauuccagccucuuuguggaggauuguaagcugccgcuuggccaaucucugugcgcccucccugacacccccuccacacugacgcccagaagcguucgcuccgugccuggggaaaugcggcuggcgagcaucgccuucaaccacccgauucaggucgaucagcuuaauucuagcuacuuuaaacucuccauccccaccaacuucucuuucggagugacacaagaguauauccagaccacaauucagaaggugaccgucgacuguaaacaguacguuugcaauggcuuucaaaagugcgaacagcugcugagagaguaugggcaguucuguagcaagaucaaccaggcucuccauggagccaaucugcgccaagaugacuccgugcggaaccuuuuugcuucugugaaaagcucccagucuagcccuauuauccccggcuucgggggcgacuuuaaucugacgcuccuggagccugucuccauuagcacaggaucuagauccgcccgcagcgcgaucgaagaucugcuuuucgacaaggugaccaucgccgaucccggcuacaugcagggguacgacgauugcaugcagcaaggaccugcuucugcccgggaccucauuugugcucaguauguugccggcuacaaagugcugcccccgcugauggaugucaacauggaggccgcuuauaccuccagccuccugggguccaucgcgggagugggcuggacagccgggcuuucuagcuuugcugccauuccuuucgcccaguccaucuuuuacagacugaauggcguuggaauuacccaacaggugcucagcgaaaaccagaagcugaucgcuaauaaauucaaccaggcccugggcgcgaugcaaacaggguuuacgaccacaaaugaggcuuuccggaagguccaggacgccgugaacaacaaugcccaggcucuuucuaagcucgccuccgaacugagcaacaccuucggagcgaucucugcuagcauuggcgauaucauucagcgccuggacguucucgagcaagaugcccagaucgacagacugauuaaugggcggcuuacaacccugaacgccuuuguggcucagcagcucgucagauccgagucugccgcucugagcgcccaacuggcgaaagauaaggugaaugaaugcgugaaagcccaguccaagcgcucuggauucuguggccagggcacgcacaucgucagcuuuguugugaacgcucccaaugggcuuuauuucaugcaugugggauacuauccuuccaaccacaucgaggucgugagcgccuacggccugugcgacgcugccaaucccaccaacuguauugccccgguuaauggguacuuuaucaaaacaaacaauacccggauuguggacgaauggucuuauacaggauccagcuucuacgcuccugagcccaucaccucccucaacacaaaguaugucgcgccucaggugaccuaccaaaauauuucuacgaaccugcccccuccccuccugggcaacagcacagggaucgauuuucaggacgagcuugaugaguucuuuaagaauguuuccaccucuauuccgaacuucggaagccugacccagaucaauacaacccuccuggaccugacguaugaaaugcuuucccugcaacagguggucaaagcccucaacgaaagcuacaucgaucugaaggagcucggcaauuauacauacuacaacaaauggcccugguauauuuggcugggcuuuaucgcugggcuuguggcccuggcccucugcgucuucuuuauucuguguugcaccggauguggcacaaauugcauggggaagcugaaaugcaacagauguugcgaccgcuacgaagaguaugaucuugagccucauaaggugcacguucacuga

SEQ ID NO: 947 - RNA, 4062 nt, Artificial Sequence
  derived and/or modified CDS sequence (opt5) from MERS-CoV__ALB08257__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucgcagacucgacguucuggagcaggaugcccaaaucgaccggcuuauuaaugggagacugacaacccucaacgccuucguggcucagcagcugguccgcucugagagcgccgcucuguccgcccagcuugcgaaagauaaggugaaugaaugcgugaaagcccaaucuaagcggagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauaccagaauuguggacgaaugguccuauacaggaagcuccuuuuacgcuccggagccuaucaccucucugaacacaaaguaugucgcgccccaggugaccuaccagaauauuagcacgaaccucccuccuccccugcuuggcaacuccacagggaucgauuuccaagacgagcuggaugaauuuuucaagaauguuucuaccagcauucccaacuuuggaucccucacccagaucaauacaacccugcuggaccuuacguaugagaugcugagccuccagcaaguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgcuguugcgacagauacgaagaguaugaucuggagccccauaaggugcacguucacuga

SEQ ID NO: 948 - RNA, 4062 nt, Artificial Sequence
  derived and/or modified CDS sequence (opt5) from MERS-CoV__ALB08311__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggcuaugcgaccgggacaaccccucaaaaacucuuuguugcuaauuacucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucacacacuuguccugcucccggacggauguggcacccugcugcgcgcguucuauugcauccucgagcccagaucugggaaccauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugggcggaccgaagucccucagcucgugaacgccaaucaauacucccccuguguuagcauugugccgucuacagucugggaggacggagacuacuaucgcaaacagcuguccccucuggaaggcgggggauggcucguggcuagcggcuccaccguugccaugacagagcagcugcagaugggguuuggcaucaccgugcaauacggaacggauaccaacucugucugccccaaacuugaguucgcgaaugacacaaagauugcuagccagcugggcaacuguguggaauauucccucuacggggugucuggaagaggcguuuuucagaauugcaccgccgucggggugcggcagcaaagauucguguaugaugccuaccagaaccuggucggauauuacagcgacgauggcaacuacuauugucugcgcgcuugcguguccguuccugugucugucaucuacgacaaggagacaaagacccacgccacgcuuuuugggagcguggcuugugaacauauuuccagcacaaugucucaguauucccggagcaccagaucuaugcucaaacgccgggauuccacauacggcccccugcagaccccuguuggaugcgugcugggccucgucaauagcucucuguucguggaggacuguaaacuuccccuggggcaaucccucugcgcccugccggauaccccuagcacacugacgcccagauccguucgcagcgugcccggagaaaugcggcuugcgucuaucgccuuuaaccacccuauucaggucgaccagcucaauagcuccuauuucaagcugucuaucccgaccaacuuuagcuucggcgugacacaagaguacauccagaccacaauucagaaggugaccgucgauuguaaacaguauguuugcaauggguuccaaaagugcgaacagcugcucagagaguacggacaguuuuguuccaagaucaaccaggcucugcacggcgccaaucuucgccaagacgauucugugcggaaccuguucgcuagcgugaaauccucucagagcucccccauuaucccuggguuuggcggagacuucaaucucacgcugcuggagcccgucagcauuucuacaggcuccagaagcgcccgcucugcgaucgaagaccuucucuuugauaaggugaccaucgccgacccuggguacaugcagggauaugaugacugcaugcagcaaggccccgcuuccgcccgggaucugauuugugcucaguacguugccggguauaaagugcugccuccccucauggacgucaacauggaggccgcuuacaccagcucccugcuuggaucuaucgcgggcgugggguggacagccggccugagcuccuucgcugccauuccguuugcccagagcaucuucuauagacucaauggaguuggcauuacccaacaggugcugucugaaaaccagaagcugaucgcuaauaaauuuaaccaggcccuuggggcgaugcaaacaggauucacgaccacaaaugaggcuuuucggaagguccaggaugccgugaacaacaaugcccaggcucucuccaagcuggccagcgaacugucuaacaccuucggcgcgaucagcgcuuccauuggggacaucauucagcgccucgauguucuggagcaagacgcccagaucgauagacuuauuaauggacggcugacaacccucaacgccuucguggcucagcagcuggucagaucugagagcgccgcucuguccgcccaacuugcgaaagacaaggugaaugaaugcgugaaagcccagucuaagcgcagcggcuuuuguggccaggggacgcauaucgucuccuucguugugaacgcuccuaauggacuguacuuuaugcacgugggcuauuaccccagcaaccauaucgaggucgugucugccuacgggcucugcgaugcugccaauccuaccaacuguauugcccccguuaauggauauuucaucaaaacaaacaauacccggauuguggacgaaugguccuacacaggcagcuccuuuuaugcuccggagccuaucaccucucugaacacaaaguacgucgcgccccaggugaccuaucaaaauauuagcacgaaccucccuccuccccugcuugggaacuccacaggaaucgacuuccaggaugagcuggacgaauuuuucaagaauguuucuaccagcauucccaacuuuggcucccucacccagaucaauacaacccugcuggaucuuacguacgagaugcugagccuccaacagguggucaaagcccugaacgaaucuuauaucgaccucaaggagcugggcaauuacacauacuauaacaaauggccgugguacauuuggcuuggguucaucgcuggacugguggcccucgcccugugcgucuuuuucauucuguguugcaccggcugugggacaaauugcaugggaaaacuuaagugcaacagauguugcgaucgcuaugaagaguacgaccuggagccccacaaggugcauguucacuga

SEQ ID NO: 949 - RNA, 4062 nt, Artificial Sequence
  derived and/or modified CDS sequence (opt5) from MERS-CoV__ALB08322__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggcuaugcgaccgggacaaccccucaaaaacucuuuguugcuaauuacucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucacacacuuguccugcucccggacggauguggcacccugcugcgcgcguucuauugcauccucgagcccagaucugggaaccauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugggcggaccgaagucccucagcucgugaacgccaaucaauacucccccuguguuagcauugugccgucuacagucugggaggacggagacuacuaucgcaaacagcuguccccucuggaaggcgggggauggcucguggcuagcggcuccaccguugccaugacagagcagcugcagaugggguuuggcaucaccgugcaauacggaacggauaccaacucugucugccccaaacuugaguucgcgaaugacacaaagauugcuagccagcugggcaacuguguggaauauucccucuacggggugucuggaagaggcguuuuucagaauugcaccgccgucggggugcggcagcaaagauucguguaugaugccuaccagaaccuggucggauauuacagcgacgauggcaacuacuauugucugcgcgcuugcguguccguuccugugucugucaucuacgacaaggagacaaagacccacgccacgcuuuuugggagcguggcuugugaacauauuuccagcacaaugucucaguauucccggagcaccagaucuaugcucaaacgccgggauuccacauacggcccccugcagaccccuguuggaugcgugcugggccucgucaauagcucucuguucguggaggacuguaaacuuccccuggggcaaucccucugcgcccugccggauaccccuagcacacugacgcccagauccguucgcagcgugcccggagaaaugcggcuugcgucuaucgccuuuaaccacccuauucaggucgaccagcucaauagcuccuauuucaagcugucuaucccgaccaacuuuagcuucggcgugacacaagaguacauccagaccacaauucagaaggugaccgucgauuguaaacaguauguuugcaauggguuccaaaagugcgaacagcugcucagagaguacggacaguuuuguuccaagaucaaccaggcucugcacggcgccaaucuucgccaagacgauucugugcggaaccuguucgcuagcgugaaauccucucagagcucccccauuaucccuggguuuggcggagacuucaaucucacgcugcuggagcccgucagcauuucuacaggcuccagaagcgcccgcucugcgaucgaagaccuucucuuugauaaggugaccaucgccgacccuggguacaugcagggauaugaugacugcaugcagcaaggccccgcuuccgcccgggaucugauuugugcucaguacguugccggguauaaagugcugccuccccucauggacgucaacauggaggccgcuuacaccagcucccugcuuggaucuaucgcgggcgugggguggacagccggccugagcuccuucgcugccauuccguuugcccagagcaucuucuauagacucaauggaguuggcauuacccaacaggugcugucugaaaaccagaagcugaucgcuaauaaauuuaaccaggcccuuggggcgaugcaaacaggauucacgaccacaaaugaggcuuuucggaagguccaggaugccgugaacaacaaugcccaggcucucuccaagcuggccagcgaacugucuaacaccuucggcgcgaucagcgcuuccauuggggacaucauucagcgccucgauguucuggagcaagacgcccagaucgauagacuuauuaauggacggcugacaacccucaacgccuucguggcucagcagcuggucagaucugagagcgccgcucuguccgcccaacuugcgaaagacaaggugaaugaaugcgugaaagcccagucuaagcgcagcggcuuuuguggccaggggacgcauaucgucuccuucguugugaacgcuccuaauggacuguacuuuaugcacgugggcuauuaccccagcaaccauaucgaggucgugucugccuacgggcucugcgaugcugccaauccuaccaacuguauugcccccguuaauggauauuucaucaaaacaaacaauacccggauuguggacgaaugguccuacacaggcagcuccuuuuaugcuccggagccuaucaccucucugaacacaaaguacgucgcgccccaggugaccuaucaaaauauuagcacgaaccucccuccuccccugcuugggaacuccacaggaaucgacuuccaggaugagcuggacgaauuuuucaagaauguuucuaccagcauucccaacuuuggcucccucacccagaucaauacaacccugcuggaucuuacguacgagaugcugagccuccaacagguggucaaagcccugaacgaaucuuauaucgaccucaaggagcugggcaauuacacauacuauaacaaauggccgugguacauuuggcuuggguucaucgcuggacugguggcccucgcccugugcgucuuuuucauucuguguugcaccggcugugggacaaauugcaugggaaaacuuaagugcaacagauguugcgaucgcuaugaagaguacgaccuggagcuccacaaggugcauguucacuga

SEQ ID NO: 950 - RNA, 4062 nt, Artificial Sequence
  derived and/or modified CDS sequence (opt5) from MERS-CoV__ALD51904__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuugugcuaagaucaaccaggcccugcauggagcuaaucuucgccaagaugacuccgugcggaaccuguucgccucugugaaaagcucccagucuagccccauuaucccuggcuuugggggcgacuucaaucucacgcugcuggagcccgucuccauuagcacaggaucuagauccgcgcgcagcgccaucgaagaucuucucuuugacaaggugaccaucgcugauccuggcuacaugcagggguacgacgauugcaugcagcaaggacccgccucugcucgggaccugauuugugcccaguauguugccggcuacaaagugcugccuccccucauggaugucaacauggaggcugcguauaccuccagccugcuuggguccaucgccggagugggcuggacagcugggcugucuagcuucgccgccauuccguuugcucaguccaucuucuacagacucaauggcguuggaauuacccaacaggugcugagcgaaaaccagaagcugaucgccaauaaauuuaaccaggcgcuuggcgcuaugcaaacaggguucacgaccacaaaugaggccuuucggaagguccaggacgccgugaacaacaaugcucaggcccucucuaagcuggcguccgaacugagcaacaccuucggagcuaucucugccagcauuggcgauaucauucagcgccucgacguucuggagcaagaugcccagaucgacagacuuauuaaugggcggcugacaacccucaacgcuuucguggcccagcagcuggucagauccgagucugcugcccugagcgcgcaacuugccaaagauaaggugaaugaaugcgugaaagcucaguccaagcgcucuggauuuuguggccagggcacgcacaucgucagcuucguugugaacgccccuaaugggcuguauuuuaugcaugugggauacuaucccuccaaccacaucgaggucgugagcgcuuacggccucugcgacgccgccaauccuaccaacuguauugcucccguuaauggguacuucaucaaaacaaacaauacccggauuguggacgaauggucuuauacaggauccagcuuuuacgcgccggagccuaucaccucccugaacacaaaguaugucgcuccccaggugaccuaccaaaauauuucuacgaaccucccuccuccccugcuuggcaacagcacagggaucgauuuccaggacgagcuggaugaauuuuucaagaauguuuccaccucuauucccaacuuuggaagccucacccagaucaauacaacccugcuggaccuuacguaugagaugcugucccuccaacagguggucaaagcccugaacgaaagcuacaucgaucucaaggagcugggcaauuauacauacuacaacaaauggccgugguauauuuggcuuggcuucaucgccgggcugguggcccucgcucugugcgucuuuuucauucuguguugcaccggauguggcacaaauugcauggggaaacuuaagugcaacagauguugcgaccgcuacgaagaguaugaucuggagccccauaaggugcacguucacuga

SEQ ID NO: 951 - RNA, 4062 nt, Artificial Sequence
  derived and/or modified CDS sequence (opt5) from MERS-CoV__ALJ54446__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuuuuauacguccuucgcuacauaccauacccccgccacagauugcagcgacggcaacuauaaucggaacgcuucucuuaauuccuucaaggaauacuuuaaccuucgcaauuguaccuucauguauaccuacaacauuacagaggaugaaauccuggagugguuuggcaucacgcagaccgcccaaggggugcaccucuucagcuccagauauguggaccuguacggaggcaauauguuucaguucgcgacacuuccugucuacgacaccauuaaauauuacucuaucauuccccacagcauccgguccauucagagcgaucgcaaggccugggcugccuuuuauguuuacaaacugcagccgcucacauuccugcuggacuuuucuguggauggguauaucagacgggcuaucgacugcggauucaacgaucucucccaacugcauuguagcuacgagucuuuugacguggaaagcggcgucuauuccgugucuagcuucgaggccaagccuuccgggagcguuguggaacaggccgagggagucgagugcgauuuuucuccccuucuguccggcaccccuccccagguguacaacuucaaacgccucguuuucacgaauuguaacuacaaucugacaaagcugcugagccucuuuucugugaacgacuucauuugcucccaaaucagccccgcugcgauugccuccaauuguuauucuagccugauccuggauuacuuuuccuauccucucucuaugaaaagcgaccuguccgucagcucugcuggcccgauuucccaguucaacuacaagcagagcuuuucuaauccuaccugccuuauccuggccaccgugccccacaaccucacaaccaucacaaagccccugaaauauuccuacauuaauaagugcagcagacuucugucugaugaccggacggaagucccucagcucgugaacgccaaucaauauagccccuguguuuccaucgugccgagcaccgucugggaggacggggauuacuaccgcaaacagcugucuccucuggaaggaggcggguggcucguggcuuccggaagcacaguugccaugaccgagcagcugcagaugggcuucgggauuacagugcaauauggcaccgacacgaacuccgucugccccaaacuugaauuugcgaaugauaccaagaucgcuucucagcugggaaacuguguggaguacagccucuauggcguguccgggagaggaguuuuccagaauugcacagccgucggcgugcggcagcaaagauuuguguacgacgccuaucagaaccuggucggguacuauucugaugacggaaacuacuacugucugcgcgcuugcgugagcguuccuguguccgucauuuaugauaaggagaccaagacacaugccacccuuuucggcucuguggcuugugaacacaucagcuccacgaugagccaguacucucgguccacaagaagcaugcucaaacgccgggacucuaccuaugggccccugcagacaccuguuggcugcgugcugggacucgucaauuccagccuguuuguggaggauuguaaacuuccccugggccaaucucucugcgcccugccggacaccccuuccacccugacacccagaagcguucgcuccgugcccggggaaaugcggcuugcgagcauugccuucaaccacccuauccaggucgaucagcucaauucuagcuacuuuaagcuguccaucccgacgaacuucucuuucggagugacccaagaguauauucagacaaccauccagaaggugacagucgacuguaaacaguacguuugcaauggcuuucaaaagugcgaacagcugcucagagaguaugggcaguucuguagcaagauuaaccaggcucugcauggagccaaucuucgccaagaugacuccgugcggaaccuguuugcuucugugaaaagcucccagucuagccccaucauuccuggcuucgggggcgacuuuaaucucacccugcuggagcccgucuccaucagcacgggaucuagauccgcccgcagcgcgaucgaagaucuucucuucgacaaggugacaauugccgauccuggcuacaugcagggguacgacgauugcaugcagcaaggacccgcuucugcccgggaccugaucugugcucaguauguugccggcuacaaagugcugccuccccucauggaugucaacauggaggccgcuuauaccuccagccugcuuggguccauugcgggagugggcuggaccgccgggcugucuagcuuugcugccaucccguucgcccaguccaucuuuuacagacucaauggcguuggaauuacacaacaggugcugagcgaaaaccagaagcugaucgcuaauaaauucaaccaggcccuuggcgcgaugcaaaccggguuuacaacgaccaaugaggcuuuccggaagguccaggacgccgugaacaacaaugcccaggcucucucuaagcuggccuccgaacugagcaacacauucggagcgauuucugcuagcaucggcgauauuauccagcgccucgacguucuggagcaagaugcccagauugacagacuuaucaaugggcggcugaccacacucaacgccuuuguggcucagcagcuggucagauccgagucugccgcucugagcgcccaacuugcgaaagauaaggugaaugaaugcgugaaagcccaguccaagcgcucuggauucuguggccagggcacccacaucgucagcuuuguugugaacgcuccuaaugggcuguauuucaugcaugugggauacuaucccuccaaccacauugaggucgugagcgccuacggccucugcgacgcugccaauccuacgaacuguaucgcccccguuaauggguacuuuauuaaaaccaacaauacacggaucguggacgaauggucuuauaccggauccagcuucuacgcuccggagccuauuacaucccugaacaccaaguaugucgcgccccaggugacauaccaaaauaucucuaccaaccucccuccuccccugcuuggcaacagcacggggauugauuuucaggacgagcuggaugaguucuuuaagaauguuuccacaucuauccccaacuucggaagccucacccagaucaauaccacacugcuggaccuuaccuaugaaaugcugucccuccaacagguggucaaagcccugaacgaaagcuacauugaucucaaggagcugggcaauuauacguacuacaacaaauggccgugguauaucuggcuuggcuuuauugcugggcugguggcccucgcccugugcgucuucuuuauccuguguugcacaggauguggcaccaauugcauggggaaacuuaagugcaacagauguugcgaccgcuacgaagaguaugaucuggagccccauaaggugcacguucacuga

SEQ ID NO: 952 - RNA, 4062 nt, Artificial Sequence
  derived and/or modified CDS sequence (opt5) from MERS-CoV__ALJ54448__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuauucuuaauuccuucaaggaauacuucaaccuucgcaauuguaccuuuauguauaccuacaacaucacagaggaugaaauccuggagugguucggcauuacgcagaccgcccaaggggugcaccucuuuagcuccagauauguggaccuguacggaggcaauauguuccaguuugcgacacuuccugucuacgacaccaucaaauauuacucuauuaucccccacagcauucgguccauccagagcgaucgcaaggccugggcugccuucuauguuuacaaacugcagccgcucacauuucugcuggacuucucuguggauggguauaucagacgggcuauugacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaacuuuaaacgccucguuuucacgaauuguaacuacaaucugacaaagcugcugagccucuucucugugaacgacuuuaccugcucccaaaucagccccgcugcgauugccuccaauuguuauucuagccugauccuggauuacuucuccuauccucucucuaugaaaagcgaccuguccgucagcucugcuggcccgauuucccaguuuaacuacaagcagagcuucucuaauccuaccugccuuauccuggccacagugccccacaaccucaccacaaucacgaagccccugaaauauuccuacauuaauaagugcagcagacuucugucugaugaccggaccgaagucccucagcucgugaacgccaaucaauauagccccuguguuuccaucgugccgagcacagucugggaggacggggauuacuaccgcaaacagcugucuccucuggaaggaggcggguggcucguggcuuccggaagcaccguugccaugacagagcagcugcagaugggcuuugggauuaccgugcaauauggcacggacaccaacuccgucugccccaaacuugaguucgcgaaugauacaaagaucgcuucucagcugggaaacuguguggaauacagccucuauggcguguccgggagaggaguuuuucagaauugcaccgccgucggcgugcggcagcaaagauucguguacgacgccuaucagaaccuggucggguacuauucugaugacggaaacuacuacugucugcgcgcuugcgugagcguuccuguguccgucauuuaugauaaggagacaaagacccaugccacgcuuuuuggcucuguggcuugugaacacaucagcuccacaaugagccaguacucucgguccaccagaagcaugcucaaacgccgggacucuacauaugggccccugcagaccccuguuggcugcgugcugggacucgucaauuccagccuguucguggaggauuguaaacuuccccugggccaaucucucugcgcccugccggacaccccuuccacacugacgcccagaagcguucgcuccgugcccggggaaaugcggcuugcgagcauugccuuuaaccacccuauccaggucgaucagcucaauucuagcuacuucaagcuguccaucccgaccaacuuuucuuucggagugacacaagaguauauucagaccacaauccagaaggugaccgucgacuguaaacaguacguuugcaauggcuuccaaaagugcgaacagcugcucagagaguaugggcaguuuuguagcaagauuaaccaggcucugcauggagccaaucuucgccaagaugacuccgugcggaaccuguucgcuucugugaaaagcucccagucuagccccaucauuccuggcuuugggggcgacuucaaucucacgcugcuggagcccgucuccaucagcacaggaucuagauccgcccgcagcgcgaucgaagaucuucucuuugacaaggugaccauugccgauccuggcuacaugcagggguacgacgauugcaugcagcaaggacccgcuucugcccgggaccugaucugugcucaguauguugccggcuacaaagugcugccuccccucauggaugucaacauggaggccgcuuauaccuccagccugcuuggguccauugcgggagugggcuggacagccgggcugucuagcuucgcugccaucccguuugcccaguccauuuucuacagacucaauggcguuggaaucacccaacaggugcugagcgaaaaccagaagcugaucgcuaauaaauuuaaccaggcccuuggcgcgaugcaaacaggguucacgaccacaaaugaggcuuuucggaagguccaggacgccgugaacaacaaugcccaggcucucucuaagcuggccuccgaacugagcaacaccuucggagcgauuucugcuagcaucggcgauauuauccagcgccucgacguucuggagcaagaugcccagauugacagacuuaucaaugggcggcugacaacccucaacgccuucguggcucagcagcuggucagauccgagucugccgcucugagcgcccaacuugcgaaagauaaggugaaugaaugcgugaaagcccaguccaagcgcucuggauuuuguggccagggcacgcacaucgucagcuucguugugaacgcuccuaaugggcuguauuuuaugcaugugggauacuaucccuccaaccacauugaggucgugagcgccuacggccucugcgacgcugccaauccuaccaacuguaucgcccccguuaauggguacuucauuaaaacaaacaauacccggaucguggacgaauggucuuauacaggauccagcuuuuacgcuccggagccuauuaccucccugaacacaaaguaugucgcgccccaggugaccuaccaaaauaucucuacgaaccucccuccuccccugcuuggcaacagcacagggauugauuuccaggacgagcuggaugaauuuuucaagaauguuuccaccucuauccccaacuuuggaagccucacccagaucaauacaacccugcuggaccuuacguaugagaugcugucccuccaacagguggucaaagcccugaacgaaagcuacauugaucucaaggagcugggcaauuauacauacuacaacaaauggccgugguauaucuggcuuggcuucauugcugggcugguggcccucgcccugugcgucuuuuucauccuguguugcaccggauguggcacaaauugcauggggaaacuuaagugcaacagauguugcgaccgcuacgaagaguaugaucuggagccccauaaggugcacguucacuga

SEQ ID NO: 953 - RNA, 4062 nt, Artificial Sequence
  derived and/or modified CDS sequence (opt5) from MERS-CoV__ALJ54450__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucgguacgcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaauucugucugccccaaacuugaguucgcgaacgauacaaagauugcuagccagcugggaaauuguguggaauauucccucuacggcgugucugggagaggaguuuuucagaacugcaccgccgucggcgugcggcagcaaagauucguguaugacgccuaccagaaucuggucggguauuacagcgaugacggaaacuacuauugucugcgcgcuugcguguccguuccugugucugucaucuacgauaaggagacaaagacccaugccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaacagcucucuguucguggaggauuguaaacuuccccugggccaaucccucugcgcccugccggacaccccuagcacacugacgcccagauccguucgcagcgugcccggggaaaugcggcuugcgucuaucgccuuuaaucacccuauucaggucgaucagcucaacagcuccuauuucaagcugucuaucccgaccaauuuuagcuucggagugacacaagaguacauccagaccacaauucagaaggugaccgucgacuguaaacaguauguuugcaacggcuuccaaaagugcgaacagcugcucagagaguacgggcaguuuuguuccaagaucaaucaggcucugcauggagccaaccuucgccaagaugacucugugcggaaucuguucgcuagcgugaaauccucucagagcucccccauuaucccuggcuuugggggcgacuucaaccucacgcugcuggagcccgucagcauuucuacaggauccagaagcgcccgcucugcgaucgaagaucuucucuuugacaaggugaccaucgccgauccuggcuacaugcagggguaugacgauugcaugcagcaaggacccgcuuccgcccgggaccugauuugugcucaguacguugccggcuauaaagugcugccuccccucauggaugucaauauggaggccgcuuacaccagcucccugcuugggucuaucgcgggagugggcuggacagccgggcugagcuccuucgcugccauuccguuugcccagagcaucuucuauagacucaacggcguuggaauuacccaacaggugcugucugaaaaucagaagcugaucgcuaacaaauuuaaucaggcccuuggcgcgaugcaaacaggguucacgaccacaaacgaggcuuuucggaagguccaggacgccgugaauaacaacgcccaggcucucuccaagcuggccagcgaacugucuaauaccuucggagcgaucagcgcuuccauuggcgauaucauucagcgccucgacguucuggagcaagaugcccagaucgacagacuuauuaacgggcggcugacaacccucaaugccuucguggcucagcagcuggucagaucugagagcgccgcucuguccgcccaacuugcgaaagauaaggugaacgaaugcgugaaagcccagucuaagcgcagcggauuuuguggccagggcacgcacaucgucuccuucguugugaaugcuccuaacgggcuguacuuuaugcaugugggauauuaccccagcaaucacaucgaggucgugucugccuacggccucugcgacgcugccaacccuaccaauuguauugcccccguuaacggguauuucaucaaaacaaauaacacccggauuguggacgaaugguccuacacaggaagcuccuuuuaugcuccggagccuaucaccucucugaauacaaaguacgucgcgccccaggugaccuaucaaaacauuagcacgaaucucccuccuccccugcuuuccaacucuacaggcaucgauuuccaggacgagcuggaugaauuuuucaagaacguuagcaccuccauucccaauuuugggagccucacccagaucaacacaacccugcuggaccuuacguacgagaugcugucucuccaacagguggucaaagcccugaaugaauccuauaucgaucucaaggagcugggaaacuacacauacuauaauaaauggccgugguacauuuggcuuggcuucaucgcuggccugguggcccucgcccugugcgucuuuuucauucuguguugcaccggguguggaacaaacugcaugggcaaacuuaagugcaauagauguugcgaccgcuaugaagaguacgaucuggagccccauaaggugcacguucacuga

SEQ ID NO: 954 - RNA, 4062 nt, Artificial Sequence
  derived and/or modified CDS sequence (opt5) from MERS-CoV__ALJ54453__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaacuauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuacuauugucugcgcgcuugcguguccguuccugugucugucaucuacgauaaggagacaaagacccacgccacgcuuuuuggcagcguggcuugugaacauauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuauuucaagcugucuaucccgaccaacuuuagcuucggagugacacaagaguacauccagaccacaauucagaaggugaccgucgacuguaaacaguauguuugcaauggcuuccaaaagugcgaacagcugcucagagaguacgggcaguuuuguuccaagaucaaccaggcucugcacggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguaugacgauugcaugcagcaaggacccgcuuccgcccgggaccugauuugugcucaguacguugccggcuauaaagugcugccuccccucauggaugucaacauggaggccgcuuacaccagcucccugcuugggucuaucgcgggagugggcuggacagccgggcugagcuccuucgcugccauuccguuugcccagagcaucuucuauagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcauaucgucuccuucguugugaacgcuccuaaugggcuguacuuuaugcacgugggauauuaccccagcaaccauaucgaggucgugucugccuacggccucugcgacgcugccaauccuaccaacuguauugcccccguuaauggguauuucaucaaaacaaacaauacccggauuguggacgaaugguccuacacaggaagcuccuuuuaugcuccggagccuaucaccucucugaacacaaaguacgucgcgccccaggugaccuaucaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguacgagaugcugagccuccaacagguggucaaagcccugaacgaaucuuauaucgaucucaaggagcugggcaauuacacauacuauaacaaauggccgugguacauuuggcuuggcuucaucgcugggcugguggcccucgcccugugcgucuuuuucauucuguguugcaccggauguggcacaaauugcauggggaaacuuaagugcaacagauguugcgaccgcuaugaagaguacgaucuggagccccacaaggugcauguucacuga

SEQ ID NO: 955 - RNA, 4062 nt, Artificial Sequence
  derived and/or modified CDS sequence (opt5) from MERS-CoV__ALJ54455__S
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaggucccucagcucgugaacgcuaaucaauauucccccuguguuagcauugugccgucuacagucugggaagacggggauuacuaccgcaaacagcuguccccucuggagggaggcggguggcucguggccagcggauccaccguugcgaugacagaacagcugcagaugggcuuugggaucaccgugcaauauggcacggacaccaacucugucugccccaaacuugaguucgcuaaugauacaaagauugccagccagcugggaaacuguguggaauacucccucuauggcgugucugggagaggaguuuuucagaauugcaccgccgucggcgugcggcagcaaagauucguguacgacgcuuaucagaaccuggucggguacuauagcgaugacggaaacuacuacugucugcgcgccugcguguccguuccugugucugucaucuaugauaaggagacaaagacccaugcuacgcuuuuuggcagcguggccugugagcacauuuccagcacaaugucucaguacucccggagcaccagaucuaaacucaagcgccgggacuccacauaugggccccugcagaccccuguuggcugcgugcugggacucgucaauagcucucuguucguggaagauuguaaacuuccccugggccaaucccucugcgcgcugccggacaccccuagcacacugaagcccagauccguucgcagcgugcccggggagaugcggcuugccucuaucgcuuuuaaccacccuauucaggucgaucagcucaauagcuccuacuucaaacugucuaucccgacgaacuuuagcuucggagugacccaagaauauauccagacaaccauucagaaggugacagucgacuguaagcaguacguuugcaauggcuuccaaaaaugcgagcagcugcucagagaauaugggcaguuuuguuccaagaucaaccaggcccugcauggagcuaaucuucgccaagaugacucugugcggaaccuguucgccagcgugaaauccucucagagcucccccauuaucccuggcuuugggggcgacuucaaucucacccugcuggagcccgucagcauuucuacgggauccagaagcgcgcgcucugccaucgaggaucuucucuuugacaaggugacaaucgcugauccuggcuacaugcagggguacgacgauugcaugcagcaaggacccgccuccgcucgggaccugauuugugcccaguauguugccggcuacaaagugcugccuccccucauggaugucaacauggaagcugcguauaccagcucccugcuugggucuaucgccggagugggcuggaccgcugggcugagcuccuucgccgccauuccguuugcucagagcaucuucuacagacucaauggcguuggaauuacacaacaggugcugucugagaaccagaagcugaucgccaauaaguuuaaccaggcgcuuggcgcuaugcaaaccggguucacaacgaccaaugaagccuuucggaaaguccaggacgccgugaacaacaaugcucaggcccucuccaagcuggcgagcgagcugucuaacacauucggagcuaucagcgccuccauuggcgauaucauucagcgccucgacguucuggaacaagaugcccagaucgacagacuuauuaaugggcggcugaccacacucaacgcuuucguggcccagcagcuggucagaucugagagcgcugcccuguccgcgcaacuugccaaagauaaggugaaugagugcgugaaagcucagucuaagcgcagcggauuuuguggccagggcacccacaucgucuccuucguugugaacgccccuaaugggcuguauuuuaugcaugugggauacuaucccagcaaccacaucgaagucgugucugcuuacggccucugcgacgccgccaauccuacgaacuguauugcucccguuaauggguacuucaucaagaccaacaauacacggauuguggacgagugguccuauaccggaagcuccuuuuacgcgccggaaccuaucacaucucugaacaccaaauaugucgcuccccaggugacauaccaaaauauuagcaccaaccucccuccuccccugcuuggcaacuccacggggaucgauuuccaggacgagcuggaugaguuuuucaagaauguuucuacaagcauucccaacuuuggaucccucacccagaucaauaccacacugcuggaccuuaccuaugaaaugcugagccuccaacagguggucaaagcccugaacgagucuuacaucgaucucaaggaacugggcaauuauacguacuacaacaaauggccgugguauauuuggcuuggcuucaucgccgggcugguggcccucgcucugugcgucuuuuucauucuguguugcacaggauguggcaccaauugcauggggaaacuuaagugcaacagauguugcgaccgcuacgaggaauaugaucuggagccccauaaggugcacguucacuga

SEQ ID NO: 956 - RNA, 4062 nt, Artificial Sequence
  derived and/or modified CDS sequence (opt5) from MERS-CoV__ALJ54456__S
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaggucccucagcucgugaacgcuaaucaauauucccccuguguuagcauugugccgucuacagucugggaagacggggauuacuaccgcaaacagcuguccccucuggagggaggcggguggcucguggccagcggauccaccguugcgaugacagaacagcugcagaugggcuuugggaucaccgugcaauauggcacggacaccaacucugucugccccaaacuugaguucgcuaaugauacaaagauugccagccagcugggaaacuguguggaauacucccucuauggcgugucugggagaggaguuuuucagaauugcaccgccgucggcgugcggcagcaaagauucguguacgacgcuuaucagaaccuggucggguacuauagcgaugacggaaacuacuacugucugcgcgccugcguguccguuccugugucugucaucuaugauaaggagacaaagacccaugcuacgcuuuuuggcagcguggccugugagcacauuuccagcacaaugucucaguacucccggagcaccagaucuaugcucaaacgccgggacuccacauaugggccccugcagaccccuguuggcugcgugcugggacucgucaauagcucucuguucguggaagauuguaaacuuccccugggccaaucccucugcgcgcugccggacaccccuagcacacugaagcccagauccguucgcagcgugcccggggagaugcggcuugccucuaucgcuuuuaaccacccuauucaggucgaucagcucaauagcuccuacuucaagcugucuaucccgacgaacuuuagcuucggagugacccaagaauauauccagacaaccauucagaaagugacagucgacuguaagcaguacguuugcaauggcuuccaaaagugcgagcagcugcucagagaauaugggcaguuuuguuccaaaaucaaccaggcccugcauggagcuaaucuucgccaagaugacucugugcggaaccuguucgccagcgugaaguccucucagagcucccccauuaucccuggcuuugggggcgacuucaaucucacccugcuggagcccgucagcauuucuacgggauccagaagcgcgcgcucugccaucgaggaucuucucuuugacaaagugacaaucgcugauccuggcuacaugcagggguacgacgauugcaugcagcaaggacccgccuccgcucgggaccugauuugugcccaguauguugccggcuacaaggugcugccuccccucauggaugucaacauggaagcugcguauaccagcucccugcuugggucuaucgccggagugggcuggaccgcugggcugagcuccuucgccgccauuccguuugcucagagcaucuucuacagacucaauggcguuggaauuacacaacaggugcugucugagaaccagaaacugaucgccaauaaguuuaaccaggcgcuuggcgcuaugcaaaccggguucacaacgaccaaugaagccuuucggaagguccaggacgccgugaacaacaaugcucaggcccucuccaaacuggcgagcgagcugucuaacacauucggagcuaucagcgccuccauuggcgauaucauucagcgccucgacguucuggaacaagaugcccagaucgacagacuuauuaaugggcggcugaccacacucaacgcuuucguggcccagcagcuggucagaucugagagcgcugcccuguccgcgcaacuugccaaggauaaagugaaugagugcgugaaggcucagucuaaacgcagcggauuuuguggccagggcacccacaucgucuccuucguugugaacgccccuaaugggcuguauuuuaugcaugugggauacuaucccagcaaccacaucgaagucgugucugcuuacggccucugcgacgccgccaauccuacgaacuguauugcucccguuaauggguacuucaucaagaccaacaauacacggauuguggacgagugguccuauaccggaagcuccuuuuacgcgccggaaccuaucacaucucugaacaccaaguaugucgcuccccaggugacauaccaaaauauuagcaccaaccucccuccuccccugcuuggcaacuccacggggaucgauuuccaggacgagcuggaugaguuuuucaaaaauguuucuacaagcauucccaacuuuggaucccucacccagaucaauaccacacugcuggaccuuaccuaugaaaugcugagccuccaacagguggucaaggcccugaacgagucuuacaucgaucucaaagaacugggcaauuauacguacuacaacaaguggccgugguauauuuggcuuggcuucaucgccgggcugguggcccucgcucugugcgucuuuuucauucuguguugcacaggauguggcaccaauugcauggggaaacuuaagugcaacagauguugcgaccgcuacgaggaauaugaucuggagccccauaaagugcacguucacuga

SEQ ID NO: 957 - RNA, 4062 nt, Artificial Sequence
  derived and/or modified CDS sequence (opt5) from MERS-CoV__ALJ54461__S
augauccacagcguguuccugcucauguuucugcuuacccccacagaguccuacgucgacguuggcccugauucugugaagccggccugcauugaaguggacauccagcaaacguucuuugauaaaaccuggcccagaccuauugacgucagcaaggcugaugggaucauuuauccccagggacggacauacuccaacaucaccaucacauaucagggccuguucccuuaccagggggaccauggagauauguauguguacucugccggccacgcgaccgggacaacgccccaaaaacucuuuguugcuaauuauagccaggacgugaagcaguucgccaacggauuugucgugcgcauuggcgccgcugccaauuccaccggcaccguuaucauuucuccuagcacauccgcuaccaucagaaaaauuuacccggccuucaugcuggggagcucugugggaaacuuuuccgauggcaagauggggcgguucuuuaaucauacacuuguccugcuccccgacggauguggcacccugcugcgcgcguucuacugcauccucgagccuagaagcgggaaccacugucccgccggaaauucuuauacguccuuugcuacauaccauaccccugccacagauugcagcgacggcaacuauaaucggaacgcuucucuuaauuccuucaaggaauacuucaaccuucgcaauuguaccuuuauguauaccuacaacauuacagaggaugaaauccuggagugguucggcaucacgcagaccgcccaaggggugcaccucuuuagcuccagauauguggaccuguacggaggcaauauguuccaguuugcgacacuucccgucuacgacaccauuaaauauuacucuaucauuccgcacagcauccgguccauucagagcgaucgcaaggccugggcugccuucuauguuuacaaacugcagccucucacauuucugcuggacuucucuguggauggguauaucagacgggcuaucgacugcggauuuaacgaucucucccaacugcauuguagcuacgagucuuucgacguggaaagcggcgucuauuccgugucuagcuuugaggccaagcccuccgggagcguuguggaacaggccgagggagucgagugcgauuucucuccucuucuguccggcaccccuccccagguguacaacuuuaaacgccucguuuucacgaauuguaacuacaaucugacaaagcugcugagccucuucucugugaacgacuuuaccugcucccaaauuagccccgcugcgaucgccuccaauuguuauucuagccugauucuggauuacuucuccuauccgcucucuaugaaaagcgaccuguccgucaccagcgcuggccccaucucucaguuuaacuacaagcaguccuucagcaauccuacaugccuuauucuggccaccgugccccacaaccucacaacgaucaccaagccucugaaauauucuuacaucaauaagugcuccagacuucugagcgaugaccggacagaagucccccagcucgugaacgccaaucaauauucuccguguguuagcauugugccuuccaccgucugggaggacggggauuacuaccgcaaacagcugagcccccuggaaggaggcggguggcucguggcuucuggauccacaguugccaugaccgagcagcugcagaugggcuuugggaucacggugcaauauggcaccgacacaaacagcgucugcccuaaacuugaguucgcgaaugauaccaagauugcuucccagcugggaaacuguguggaauacucucucuauggcgugagcgggagaggaguuuuucagaauugcacagccgucggcgugcggcagcaaagauucguguacgacgccuaucagaaccuggucggguacuauuccgaugacggaaacuacuacugucugcgcgcuugcgugucuguucccgugagcgucaucuaugauaaggagaccaagacgcaugccacacuuuuuggcuccguggcuugugaacacauuucuagcaccaugucccaguacagccggucuacaagauccaugcucaaacgccgggacagcaccuaugggccucugcagaccucuguuggcugcgugcugggacucgucaauuccagccuguucguggaggauuguaaacuuccccugggccaaucucucugcgcccugccggacacaccuuccacgcugacccccagaagcguucgcuccgugcccggggaaaugcggcuugcgagcaucgccuuuaaccacccuauucaggucgaucagcucaauucuagcuacuucaagcuguccaucccgacaaacuuuucuuucggagugacccaagaguauauccagacaaccauucagaaggugacggucgacuguaaacaguacguuugcaauggcuuccaaaagugcgaacagcugcucagagaguaugggcaguuuuguagcaagaucaaccaggcucugcauggagccaaucuucgccaagaugacuccgugcggaaccuguucgcuucugugaaaagcucccagucuagccccauuaucccuggcuuugggggcgacuucaaucucacacugcuggagcccgucuccauuagcaccggaucuagauccgcccgcagcgcgaucgaagaucuucucuuugacaaggugaccaucgccgauccuggcuacaugcagggguacgacgauugcaugcagcaaggacccgcuucugcccgggaccugauuugugcucaguauguugccggcuacaaagugcugccuccccucauggaugucaacauggaggccgcuuauacauccagccugcuuggguccaucgcgggagugggcuggaccgccgggcugucuagcuucgcugccauuccguuugcccaguccaucuucuacagacucaauggcguuggaauuacacaacaggugcugagcgaaaaccagaagcugaucgcuaauaaauuuaaccaggcccuuggcgcgaugcaaacgggguucaccacaaccaaugaggcuuuucggaagguccaggacgccgugaacaacaaugcccaggcucucucuaagcuggccuccgaacugagcaacacauucggagcgaucucugcuagcauuggcgauaucauucagcgccucgacguucuggagcaagaugcccagaucgacagacuuauuaaugggcggcugaccacgcucaacgccuucguggcucagcagcuggucagauccgagucugccgcucugagcgcccaacuugcgaaagauaaggugaaugaaugcgugaaagcccaguccaagcgcucuggauuuuguggccagggcacccacaucgucagcuucguugugaacgcuccuaaugggcuguauuuuaugcaugugggauacuaucccuccaaccacaucgaggucgugagcgccuacggccucugcgacgcugccaauccuacaaacuguauugcccccguuaauggguacuucaucaaaaccaacaauacacggauuguggacgaauggucuuauaccggauccagcuuuuacgcuccggagccuaucacaucccugaacaccaaguaugucgcgccccaggugacguaccaaaauauuucuacaaaccucccuccuccccugcuuggcaacagcaccgggaucgauuuccaggacgagcuggaugaauuuuucaagaauguuuccaccucuauucccaacuuuggaagccucacacagaucaauaccacgcugcuggaccuuacauaugagaugcugucccuccaacagguggucaaagcccugaacgaaagcuacaucgaucucaaggagcugggcaauuauaccuacuacaacaaauggccgugguauauuuggcuuggcuucaucgcugggcugguggcccucgcccugugcgucuuuuucauucuguguugcacaggauguggcaccaauugcauggggaaacuuaagugcaacagauguugcgaccgcuacgaagaguaugaucuggagccccauaaggugcacguucacuga

SEQ ID NO: 958 - RNA, 4062 nt, Artificial Sequence
  derived and/or modified CDS sequence (opt5) from MERS-CoV__ALJ54468__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuauuugcagccaaaucucccccgcugcgauugccucuaauuguuauagcucccugauccuggauuacuucucuuauccucucagcaugaaguccgaccugagcgucucuuccgcuggcccgauuagccaguuuaacuacaagcagucuuucuccaauccuaccugccuuauccuggccaccgugccccacaaccucacaaccaucacaaagccccugaaauauagcuacauuaauaagugcucuagacuucugagcgaugaccggacggaagucccucagcucgugaacgccaaucaauauucccccuguguuagcaucgugccgucuaccgucugggaggacggggauuacuaccgcaaacagcuguccccucuggaaggaggcggguggcucguggcuagcggauccacaguugccaugaccgagcagcugcagaugggcuuugggauuacagugcaauauggcaccgacacgaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacacaugccacccuuuuuggcagcguggcuugugaacacaucuccagcacgaugucucaguacucccggagcacaagaucuaugcucaaacgccgggacuccaccuaugggccccugcagacaccuguuggcugcgugcugggacucgucaauagcucucuguucguggaggauuguaaacuuccccugggccaaucccucugcgcccugccggacaccccuagcacccugacacccagauccguucgcagcgugcccggggaaaugcggcuugcgucuauugccuuuaaccacccuauccaggucgaucagcucaauagcuccuacuucaagcugucuaucccgacgaacuuuagcuucggagugacccaagaguauauucagacaaccauccagaaggugacagucgacuguaaacaguacguuugcaauggcuuccaaaagugcgaacagcugcucagagaguaugggcaguuuuguuccaagauuaaccaggcucugcauggagccaaucuucgccaagaugacucugugcggaaccuguucgcuagcgugaaauccucucagagcucccccaucauuccuggcuuugggggcgacuucaaucucacccugcuggagcccgucagcaucucuacgggauccagaagcgcccgcucugcgaucgaagaucuucucuuugacaaggugacaauugccgauccuggcuacaugcagggguacgacgauugcaugcagcaaggacccgcuuccgcccgggaccugaucugugcucaguauguugccggcuacaaagugcugccuccccucauggaugucaacauggaggccgcuuauaccagcucccugcuugggucuauugcgggagugggcuggaccgccgggcugagcuccuucgcugccaucccguuugcccagagcauuuucuacagacucaauggcguuggaaucacacaacaggugcugucugaaaaccagaagcugaucgcuaauaaauuuaaccaggcccuuggcgcgaugcaaaccggguucacaacgaccaaugaggcuuuucggaagguccaggacgccgugaacaacaaugcccaggcucucuccaagcuggccagcgaacugucuaacacauucggagcgauuagcgcuuccaucggcgauauuauccagcgccucgacguucuggagcaagaugcccagauugacagacuuaucaaugggcggcugaccacacucaacgccuucguggcucagcagcuggucagaucugagagcgccgcucuguccgcccaacuugcgaaagauaaggugaaugaaugcgugaaagcccagucuaagcgcagcggauuuuguggccagggcacccacaucgucuccuucguugugaacgcuccuaaugggcuguauuuuaugcaugugggauacuaucccagcaaccacauugaggucgugucugccuacggccucugcgacgcugccaauccuacgaacuguaucgcccccguuaauggguacuucauuaaaaccaacaauacacggaucguggacgaaugguccuauaccggaagcuccuuuuacgcuccggagccuauuacaucucugaacaccaaguaugucgcgccccaggugacauaccaaaauaucagcaccaaccucccuccuccccugcuuggcaacuccacggggauugauuuccaggacgagcuggaugaauuuuucaagaauguuucuacaagcauccccaacuuuggaucccucacccagaucaauaccacacugcuggaccuuaccuaugagaugcugagccuccaacagguggucaaagcccugaacgaaucuuacauugaucucaaggagcugggcaauuauacguacuacaacaaauggccgugguauaucuggcuuggcuucauugcugggcugguggcccucgcccugugcgucuuuuucauccuguguugcacaggauguggcaccaauugcauggggaaacuuaagugcaacagauguugcgaccgcuacgaagaguaugaucuggagccccauaaggugcacguucacuga

SEQ ID NO: 959 - RNA, 4062 nt, Artificial Sequence
  derived and/or modified CDS sequence (opt5) from MERS-CoV__ALJ54471__S
augauccacagcguguaccugcucauguuccugcuuacccccacagaguccuaugucgacguuggcccugauucugucaagagcgccugcauugaaguggacauccagcaaacguuuuucgauaaaaccuggccgagacccauugacguguccaaggcugaugggaucauuuacccucagggacggacauauucuaacaucaccaucacauaccagggccuguuucccuaucagggggaccauggagauauguacguguauagcgccggccacgcgaccgggacaaccccucaaaaacucuucguugcuaauuacucccaggacgugaagcaguuugccaacggauucgucgugcgcauuggcgccgcugccaauucuacgggcaccguuaucauuagccccuccacaagcgcuaccaucagaaaaauuuacccugccuuuaugcuggggucuuccgugggaaacuucagcgauggcaagauggggcgguuuuucaaucauacacuuguccugcucccggacggauguggcacccugcugcgcgcguuuuauugcauccucgagcccagaucugggaaccacuguccugccggaaauuccuacacgagcuucgcuacauaucauacccccgccacagauugcucugacggcaacuacaaucggaacgcuucccugaauagcuuuaaggaauauuucaaccuucgcaauuguaccuucauguacaccuauaacauuacagaggaugaaauccuggagugguuuggcaucacgcagaccgcccaaggggugcaccucuucuccucuagauacguggaccuguacggaggcaauauguuucaguucgcgacacuuccugucuaugacaccauuaaauacuauagcaucauuccccacuccauccggagcauucagucugaucgcaaggccugggcugccuuuuacguuuauaaacugcagccgcucacauuccugcuggacuuuuccguggauggguacaucagacgggcuaucgacugcggauucaacgaucucagccaacugcauuguucuuaugagagcuuugacguggaauccggcgucuacucugugagcuccuucgaggccaagccuagcgggucuguuguggaacaggccgagggagucgagugcgauuuuagcccccuucuguccggcaccccuccccagguguacaacuucaaacgccucguuuuuacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguucaacuauaagcagucuuuuuccaauccuaccugccuuauucuggccacagugccccacaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuucgggaucaccgugcaauacggcacggacaccaacucugucugccccaaacuugaauuugcgaaugauacaaagauugcuagccagcugggaaacuguguggaguauucccucuacggcgugucugggagaggaguuuuccagaauugcaccgccgucggcgugcggcagcaaagauuuguguaugacgccuaccagaaccuggucggguauuacagcgaugacggaaacuacuauugucugcgcgcuugcguguccguuccugugucugucaucuacgauaaggagacaaagacccaugccacgcuuuucggcagcguggcuugugaacacauuuccagcacaaugucucaguauucccggagcaccagaucuaugcucaaacgccgggacuccacauacgggccccugcagaccccuguuggcugcgugcugggacucgucaauagcucucuguuuguggaggauuguaaacuuccccugggccaaucccucugcgcccugccggacaccccuagcacacugacgcccagauccguucgcagcgugcccggggaaaugcggcuugcgucuaucgccuucaaccacccuauucaggucgaucagcucaauagcuccuauuuuaagcugucuaucccgaccaacuucagcuuuggagugacacaagaguacauccagaccacaauucagaaggugaccgucgacuguaaacaguauguuugcaauggcuuccaaaagugcgaacagcugcucagagaguacgggcaguucuguuccaagaucaaccaggcucugcauggagccaaucuucgccaagaugacucugugcggaaccuguuugcuagcgugaaauccucucagagcucccccauuaucccuggcuucgggggcgacuuuaaucucacgcugcuggagcccgucagcauuucuacaggauccagaagcgcccgcucugcgaucgaagaucuucucuucgacaaggugaccaucgccgauccuggcuacaugcagggguaugacgauugcaugcagcaaggacccgcuuccgcccgggaccugauuugugcucaguacguugccggcuauaaagugcugccuccccucauggaugucaacauggaggccgcuuacaccagcucccugcuugggucuaucgcgggagugggcuggacagccgggcugagcuccuuugcugccauuccguucgcccagagcaucuuuuauagacucaauggcguuggaauuacccaacaggugcugucugaaaaccagaagcugaucgcuaauaaauucaaccaggcccuuggcgcgaugcaaacaggguuuacgaccacaaaugaggcuuuccggaagguccaggacgccgugaacaacaaugcccaggcucucuccaagcuggccagcgaacugucuaacaccuuuggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauucuguggccagggcacgcacaucgucuccuuuguugugaacgcuccuaaugggcuguacuucaugcaugugggauauuaccccagcaaccacaucgaggucgugucugccuacggccucugcgacgcugccaauccuaccaacuguauugcccccguuaauggguauuuuaucaaaacaaacaauacccggauuguggacgaaugguccuacacaggaagcuccuucuaugcuccggagccuaucaccucucugaacacaaaguacgucgcgccccaggugaccuaucaaaauauuagcacgaaccucccuccuccccugcuuggcaacuccacagggaucgauuuucaggacgagcuggaugaguucuuuaagaauguuucuaccagcauucccaacuucggaucccucacccauaucaauacaacccugcuggaccuuacguacgaaaugcugagccuccagcaaguggucaaagcccugaacgaaucuuauaucgaucucaaggagcugggcaauuacacauacuauaacaaauggccgugguacauuuggcuuggcuuuaucgcugggcugguggcccucgcccugugcgucuucuuuauucuguguugcaccggauguggcacaaauugcauggggaaacuuaagugcaacagauguugcgaccgcuaugaagaguacgaucuggagccccacaaggugcacguucauuga

SEQ ID NO: 960 - RNA, 4062 nt, Artificial Sequence
  derived and/or modified CDS sequence (opt5) from MERS-CoV__ALJ54472__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcugcagcaacgguucguguacgacgccuaucagaaccuggucggguacuauagcgaugacggaaacuacuacugucuuagagcuugcguguccguuccugugucugucaucuaugauaaggagacaaagacccaugccacgcucuuuggcagcguggcuugugaacacauuuccagcacaaugucucaguacucccgcagcacccggucuaugcugaaaagacgcgacuccacauaugggccccugcagaccccuguuggcugcgugcucggacuggucaauagcucucuuuucguggaggauuguaagcugccccucggccaaucccugugcgcccugccggacaccccuagcacacuugcgccccgguccguuagaagcgugcccggggaaaugcgccucgccucuaucgcuuuuaaccacccuauucaggucgaucagcugaauagcuccuacuucaaacugucuaucccgacgaacuuuagcuucggagugacccaagaguauauccagacaaccauucagaaggugacagucgacuguaaacaguacguuugcaauggcuuccaaaagugcgaacagcuccugcgggaguaugggcaguuuuguuccaagaucaaccaggcccuucauggagcuaaucugagacaagaugacucugugcgcaaccucuucgccagcgugaaauccucucagagcucccccauuaucccuggcuuugggggcgacuucaaucugacccugcuugagcccgucagcauuucuacgggaucccggagcgcgagaucugccaucgaagaucuccuguuugacaaggugacaaucgcugauccuggcuacaugcagggguacgacgauugcaugcagcaaggacccgccuccgcucgcgaccugauuugugcccaguauguugccggcuacaaagugcucccuccccugauggaugucaacauggaggcugcguauaccagcucccuucuggggucuaucgccggagugggcuggaccgcugggcucagcuccuucgccgccauuccguuugcucagagcaucuucuaccggcugaauggcguuggaauuacacaacaggugcugucugaaaaccagaaacuuaucgccaauaaguuuaaccaggcgcucggcgcuaugcaaaccggguucacaacgaccaaugaggccuuuagaaagguccaggacgccgugaacaacaaugcucaggcccuguccaagcuggcgagcgaacucucuaacacauucggagcuaucagcgccuccauuggcgauaucauucagcggcuggacguucuugagcaagaugcccagaucgaccgccugauuaaugggagacucaccacacugaacgcuuucgugucucagcagcugguccggagcgaguccgccgcucuuucugcccaacuggcgaaagauaaggugaaugaaugcgugaaagcccagagcaagagauccggauuuuguggccagggcacccacaucgucagcuucguugugaacgcuccuaaugggcucuauuuuaugcaugugggauacuaucccucuaaccacaucgaggucguguccgccuacggccugugcgacgcugccaauccuacgaacuguauugcccccguuaauggguacuucaucaaaaccaacaauacacgcauuguggacgaauggagcuauaccggauccucuuuuuacgcuccggagccuaucacaagccucaacaccaaguaugucgcgccccaggugacauaccaaaauauuuccaccaaccugccuccuccccuucugggcaacucuacggggaucgauuuccaggacgagcucgaugaauuuuucaagaauguuagcacauccauucccaacuuuggaagccugacccagaucaauaccacacugcuugaccugaccuaugagaugcucucucugcaacagguggucaaagcccucaacgaauccuacaucgaucugaaggagcuuggcaauuauacguacuacaacaaauggccgugguauauuuggcugggcuucaucgcugggcucguggcccuggcccugugcgucuuuuucauucuuuguugcacaggauguggcaccaauugcauggggaagcugaaaugcaaccgguguugcgacagauacgaagaguaugaucucgagccccauaaggugcacguucacuga

SEQ ID NO: 961 - RNA, 4062 nt, Artificial Sequence
  derived and/or modified CDS sequence (opt5) from MERS-CoV__ALJ54474__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccucuacagauugcuccgacggcaacuauaaucggaacgccagccuuaauuccuucaaggaauacuucaaccuucgcaauuguaccuuuauguauaccuacaacauuacagaggaugaaauccuggagugguucggcaucacgcagaccgcucaaggggugcaccucuuuucuagcagauauguggaccuguacggaggcaauauguuccaguuugccacacuuccugucuacgacaccauuaaauauuacuccaucauuccccacagcauccggucuauucaguccgaucgcaaggcgugggccgcuuucuauguuuacaaacugcagccgcucacauuucugcuggacuucagcguggauggguauaucagacgggccaucgacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcaccccuccccagguguacaacuuuaaacgccucguuuucacgaauuguaacuacaaucugacaaagcugcugucccucuucagcgugaacgacuuuaccugcucccaaauuucucccgccgcuaucgcgagcaauuguuauuccucucugauucuggauuacuucagcuauccucucuccaugaaaagcgaccugucugucuccagcgccggcccgaucucucaguuuaacuacaagcaguccuucagcaauccuaccugccuuauucuggcuacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggagaggaguuuuucagaauugcaccgcugucggcgugcggcagcaaagauucguguacgacgccuaucagaaccuggucggguacuauuccgaugacggaaacuacuacugucugcgcgccugcgugucuguuccugugagcgucaucuaugauaaggagacaaagacccaugcuacgcuuuuuggcuccguggccugugaacacauuagcucuacaaugucccaguacagccggucuaccagauccaugcucaaacgccgggacagcacauaugggccccugcagaccccuguuggcugcgugcugggacucgucaauucuucccuguucguggaggauuguaaacuuccccugggccaaagccucugcgcucugccggacaccccuuccacacugacgcccagaagcguucgcucugugcccggggaaaugcggcuugccagcaucgcguuuaaccacccuauucaggucgaucagcucaauuccucuuacuucaagcugagcaucccgaccaacuuuuccuucggagugacacaagaguauauccagaccacaauucagaaggugaccgucgacuguaaacaguacguuugcaauggcuuccaaaagugcgaacagcugcucagagaguaugggcaguuuuguucuaagaucaaccaggcccugcauggagcuaaucuucgccaagaugacagcgugcggaaccuguucgccuccgugaaaucuagccaguccagccccauuaucccuggcuuugggggcgacuucaaucucacgcugcuggagcccgucucuauuuccacaggaagcagaucugcucgcuccgccaucgaagaucuucucuuugacaaggugaccaucgcggauccuggcuacaugcagggguacgacgauugcaugcagcaaggacccgccagcgcucgggaccugauuugugcccaguauguugcuggcuacaaagugcugccuccccucauggaugucaacauggaggccgccuauaccuccucucugcuugggagcaucgcuggagugggcuggacagcggggcuguccagcuucgccgcuauuccguuugcccagucuaucuucuacagacucaauggcguuggaauuacccaacaggugcuguccgaaaaccagaagcugaucgccaauaaauuuaaccaggcucuuggcgccaugcaaacaggguucacgaccacaaaugaggcguuucggaagguccaggacgcugugaacaacaaugcccaggcccucagcaagcuggcuucugaacugagcaacaccuucggagccaucuccgcgucuauuggcgauaucauucagcgccucgacguucuggagcaagaugcucagaucgacagacuuauuaaugggcggcugacaacccucaacgccuucguggcccagcagcuggucagaagcgaguccgcugcccugucugcucaacuugccaaagauaaggugaaugaaugcgugaaagcgcagagcaagcgcuccggauuuuguggccagggcacgcacaucgucagcuucguugugaacgccccuaaugggcuguauuuuaugcaugugggauacuaucccucuaaccacaucgaggucguguccgcuuacggccucugcgacgccgcuaauccuaccaacuguauugcccccguuaauggguacuucaucaaaacaaacaauacccggguggucgacgaauggagcuauacaggauccucuuuuuacgccccggagccuauuaccagccugaacacaaaguauguggcuccccagguuaccuaccaaaauaucuccacgaaccucccuccuccccugcuuucuaacagcacaggcauugauuuccaggacgagcuggaugaauuuuucaagaauguguccaccagcauccccaacuuugggucucucacccagauuaauacaacccugcuggaccuuacguaugagaugcugucccuccaacaggucgugaaagcgcugaacgaaagcuacaucgaucucaaggagcugggaaauuauacauacuacaacaaauggccgugguauaucuggcuuggcuucauugccggccuggucgcucucgcccugugcguguuuuucauccuguguugcaccggguguggaacaaauugcaugggcaaacuuaagugcaacagauguugcgaccgcuacgaagaguaugaucuggagccccauaagguucacgugcacuga

SEQ ID NO: 962 - RNA, 4062 nt, Artificial Sequence
  derived and/or modified CDS sequence (opt5) from MERS-CoV__ALJ54483__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucuuucaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccagaagcguucgcuccgugcccggggaaaugcggcuugcgagcaucgccuucaaccacccuauucaggucgaucagcucaauucuagcuacuuuaagcuguccaucccgaccaacuucucuuucggagugacacaagaguauauccagaccacaauucagaaggugaccgucgacuguaaacaguacguuugcaauggcuuucaaaagugcgaacagcugcucagagaguaugggcaguucuguagcaagaucaaccaggcucugcauggagccaaucuucgccaagaugacuccgugcggaaccuguuugcuucugugaaaagcucccagucuagccccauuaucccuggcuucgggggcgacuuuaaucucacgcugcuggagcccgucuccauuagcacaggaucuagauccgcccgcagcgcgaucgaagaucuucucuucgacaaggugaccaucgccgauccuggcuacaugcagggguacgacgauugcaugcagcaaggacccgcuucugcccgggaccugauuugugcucaguauguugccggcuacaaagugcugccuccccucauggaugucaacauggaggccgcuuauaccuccagccugcuuggguccaucgcgggagugggcuggacagccgggcugucuagcuuugcugccauuccguucgcccaguccaucuuuuacagacucaauggcguuggaauuacccaacaggugcugagcgaaaaccagaagcugaucgcuaauaaauucaaccaggcccuuggcgcgaugcaaacaggguuuacgaccacaaaugaggcuuuccggaagguccaggacgccgugaacaacaaugcccaggcucucucuaagcuggccuccgaacugagcaacaccuucggagcgaucucugcuagcauuggcgauaucauucagcgccucgacguucuggagcaagaugcccagaucgacagacuuauuaaugggcggcugacaacccucaacgccuuuguggcucagcagcuggucagauccgagucugccgcucugagcgcccaacuugcgaaagauaaggugaaugaaugcgugaaagcccaguccaagcgcucuggauucuguggccagggcacgcacaucgucagcuuuguugugaacgcuccuaaugggcuguauuucaugcaugugggauacuaucccuccaaccacaucgaggucgugagcgccuacggccucugcgacgcugccaauccuaccaacuguauugcccccguuaauggguacuuuaucaaaacaaacaauacccggauuguggacgaauggucuuauacaggauccagcuucuacgcuccggagccuaucaccucccugaacacaaaguaugucgcgccccaggugaccuaccaaaauauuucuacgaaccucccuccuccccugcuuggcaacagcacagggaucgauuuucaggacgagcuggaugaguucuuuaagaauguuuccaccucuauucccaacuucggaagccucacccagaucaauacaacccugcuggaccuuacguaugaaaugcugucccuccaacagguggucaaagcccugaacgaaagcuacaucgaucucaaggagcugggcaauuauacauacuacaacaaauggccgugguauauuuggcuuggcuuuaucgcugggcugguggcccucgcccugugcgucuucuuuauucuguguugcaccggauguggcacaaauugcauggggaaacuuaagugcaacagauguugcgaccgcuacgaagaguaugaucuggagccccauaaggugcacguucacuga

SEQ ID NO: 963 - RNA, 4062 nt, Artificial Sequence
  derived and/or modified CDS sequence (opt5) from MERS-CoV__ALJ54486__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucgguacgcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucgugguuagcggauccaccguggcuaugacagagcagcugcagaugggcuuugggaucaccguccaauacggcacggacaccaauucugugugccccaaacuugaguucgccaacgauacaaagauugcgagccagcugggaaauuguguggaauauucccucuacggcguuucugggagaggagucuuucagaacugcaccgcugugggcgugcggcagcaaagauucgucuaugacgccuaccagaaucuggugggguauuacagcgaugacggaaacuacuauugucugcgcgccugcguuuccgugccugucucugugaucuacgauaaggagacaaagacccaugcuacgcuuuuuggcagcguugccugugaacacauuuccagcacaaugucucaguauucccggagcaccagaucuaugcucaaacgccgggacuccacauacgggccccugcagaccccugugggcugcguccugggacucgugaacagcucucuguucguugaggauuguaaacuuccccugggccaaucccucugcgcucugccggacaccccuagcacacugacgcccagauccgugcgcagcguccccggggaaaugcggcuugccucuaucgcguuuaaucacccuauucagguggaucagcucaacagcuccuauuucaagcugucuaucccgaccaauuuuagcuucggagugacacaagaguacauccagaccacaauucagaaggucaccguugacuguaaacaguaugugugcaacggcuuccaaaagugcgaacagcugcucagagaguacgggcaguuuuguuccaagaucaaucaggcccugcauggagcuaaccuucgccaagaugacucugugcggaaucuguucgccagcgucaaauccucucagagcucccccauuaucccuggcuuugggggcgacuucaaccucacgcugcuggagcccgugagcauuucuacaggauccagaagcgcucgcucugccaucgaagaucuucucuuugacaagguuaccaucgcggauccuggcuacaugcagggguaugacgauugcaugcagcaaggacccgccuccgcucgggaccugauuugugcccaguacguggcuggcuauaaaguccugccuccccucauggaugugaauauggaggccgccuacaccagcucccugcuugggucuaucgcuggaguuggcuggacagcggggcugagcuccuucgccgcuauuccguuugcccagagcaucuucuauagacucaacggcgugggaauuacccaacagguccugucugaaaaucagaagcugaucgccaacaaauuuaaucaggcucuuggcgccaugcaaacaggguucacgaccacaaacgaggcguuucggaaggugcaggacgcuguuaauaacaacgcccaggcccucuccaagcuggcuagcgaacugucuaauaccuucggagccaucagcgcguccauuggcgauaucauucagcgccucgacgugcuggagcaagaugcucagaucgacagacuuauuaacgggcggcugacaacccucaaugccuucgucgcccagcagcuggugagaucugagagcgcugcccuguccgcucaacuugccaaagauaaggugaacgaaugcgucaaagcgcagucuaagcgcagcggauuuuguggccagggcacgcacaucguuuccuucguggugaaugccccuaacgggcuguacuuuaugcaugucggauauuaccccagcaaucacaucgaggugguuucugcuuacggccucugcgacgccgcuaacccuaccaauuguauugcccccgugaacggguauuucaucaaaacaaauaacacccggauugucgacgaaugguccuacacaggaagcuccuuuuaugccccggagccuaucaccucucugaauacaaaguacguggcuccccagguuaccuaucaaaacauuagcacgaaucucccuccuccccugcuuuccaacucuacaggcaucgauuuccaggacgagcuggaugaauuuuucaagaacgugagcaccuccauucccaauuuugggagccucacccagaucaacacaacccugcuggaccuuacguacgagaugcugucucuccaacaggucgugaaagcgcugaaugaauccuauaucgaucucaaggagcugggaaacuacacauacuauaauaaauggccgugguacauuuggcuuggcuucaucgccggccuggucgcucucgcccugugcguguuuuucauucuguguugcaccggguguggaacaaacugcaugggcaaacuuaagugcaauagauguugcgaccgcuaugaagaguacgaucuggagccccauaagguucacgugcacuga

SEQ ID NO: 964 - RNA, 4062 nt, Artificial Sequence
  derived and/or modified CDS sequence (opt5) from MERS-CoV__ALJ54488__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauuuauguguacagcgccggccacgcgaccgggacaaccccucaaaaacucuuuguugcuaauuauucccaggacgugaagcaguucgccaacggauuugucgugcgcaucggcgccgcugccaauucuacgggcaccguuauuaucagccccuccacaagcgcuaccauuagaaaaaucuacccugccuucaugcuggggucuuccgugggaaacuuuagcgauggcaagauggggcgguucuuuaaucauacacuuguccugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauccuggagugguucggcauuacgcagaccgcccaaggggugcaccucuuuuccucuagauauguggaccuguacggaggcaauauguuccaguuugcgacacuuccugucuacgacaccaucaaauauuacagcauuaucccccacuccauucggagcauccagucugaucgcaaggccugggcugccuucuauguuuacaaacugcagccgcucacauuucugcuggacuucuccguggauggguauaucagacgggcuauugacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaaucucccccgcugcgauugccucuaauuguuauagcucccugauccuggauuacuucucuuauccucucagcaugaaguccgaccugagcgucucuuccgcuggcccgauuagccaguuuaacuacaagcagucuuucuccaauccuaccugccuuauccuggccacagugccccacaaccucaccacaaucacgaagccccugaaauauagcuacauuaauaagugcucuagacuucugagcgaugaccggaccgaagucccucagcucgugaacgccaaucaauauucccccuguguuagcaucgugccgucuacagucugggaggacggggauuacuaccgcaaacagcuguccccucuggaaggaggcggguggcucguggcuagcggauccaccguugccaugacagagcagcugcagaugggcuuugggauuaccgugcaauauggcacggacaccaacucugucugccccaaacuugaguucgcgaaugauacaaagaucgcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucauuuaugauaaggagacaaagacccaugccacgcuuuuuggcagcguggcuugugaacacaucuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuauugccuuuaaccacccuauccaggucgaucagcucaauagcuccuacuucaagcugucuaucccgaccaacuuuagcuucggagugacacaagaguauauucagaccacaauccagaaggugaccgucgacuguaaacaguacguuugcaauggcuuccaaaagugcgaacagcugcucagagaguaugggcaguuuuguuccaagauuaaccaggcucugcauggagccaaucuucgccaagaugacucugugcggaaccuguucgcuagcgugaaauccucucagagcucccccaucauuccuggcuuugggggcgacuucaaucucacgcugcuggagcccgucagcaucucuacaggauccagaagcgcccgcucugcgaucgaagaucuucucuuugacaaggugaccauugccgauccuggcuacaugcagggguacgacgauugcaugcagcaaggacccgcuuccgcccgggaccugaucugugcucaguauguugccggcuacaaagugcugccuccccucauggaugucaacauggaggccgcuuauaccagcucccugcuugggucuauugcgggagugggcuggacagccgggcugagcuccuucgcugccaucccguuugcccagagcauuuucuacagacucaauggcguuggaaucacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgauuagcgcuuccaucggcgauauuauccagcgccucgacguucuggagcaagaugcccagauugacagacuuaucaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacauugaggucgugucugccuacggccucugcgacgcugccaauccuaccaacuguaucgcccccguuaauggguacuucauuaaaacaaacaauacccggaucguggacgaaugguccuauacaggaagcuccuuuuacgcuccggagccuauuaccucucugaacacaaaguaugucgcgccccaggugaccuaccaaaauaucagcacgaaccucccuccuccccugcuuggcaacuccacagggauugauuuccaggacgagcuggaugaauuuuucaagaauguuucuaccagcauccccaacuuuggaucccucacccagaucaauacaacccugcuggaccuuacguaugagaugcugagccuccaacagguggucaaagcccugaacgaaucuuacauugaucucaaggagcugggcaauuauacauacuacaacaaauggccgugguauaucuggcuuggcuucauugcugggcugguggcccucgcccugugcgucuuuuucauccuguguugcaccggauguggcacaaauugcauggggaaacuuaagugcaacagauguugcgaccgcuacgaagaguaugaucuggagccccauaaggugcacguucacuga

SEQ ID NO: 965 - RNA, 4062 nt, Artificial Sequence
  derived and/or modified CDS sequence (opt5) from MERS-CoV__ALJ54490__S
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugggcggaccgaggucccucagcucgugaacgcuaaucaauauucccccuguguuagcauugugccgucuacagucugggaagacggagacuacuaccgcaaacagcuguccccucuggagggcgggggauggcucguggccagcggcuccaccguugcgaugacagaacagcugcagaugggguuuggcaucaccgugcaauauggaacggauaccaacucugucugccccaaacuugaguucgcuaaugacacaaagauugccagccagcugggcaacuguguggaauacucccucuauggggugucuggaagaggcguuuuucagaauugcaccgccgucggggugcggcagcaaagauucguguacgaugcuuaucagaaccuggucggauacuauagcgacgauggcaacuacuacugucugcgcgccugcguguccguuccugugucugucaucuaugacaaggagacaaagacccaugcuacgcuuuuugggagcguggccugugagcacauuuccagcacaaugucucaguacucccggagcaccagaucuaugcucaaacgccgggauuccacauauggcccccugcagaccccuguuggaugcgugcugggccucgucaauagcucucuguucguggaagacuguaaacuuccccuggggcaaucccucugcgcgcugccggauaccccuagcacacugaagcccagauccguucgcagcgugcccggagagaugcggcuugccucuaucgcuuuuaaccacccuauucaggucgaccagcucaauagcuccuacuucaagcugucuaucccgacgaacuuuagcuucggcgugacccaagaauauauccagacaaccauucagaaagugacagucgauuguaagcaguacguuugcaauggguuccaaaagugcgagcagcugcucagagaauauggacaguuuuguuccaaaaucaaccaggcccugcauggcgcuaaucuucgccaagacgauucugugcggaaccuguucgccagcgugaaguccucucagagcucccccauuaucccuggguuuggcggagacuucaaucucacccugcuggagcccgucagcauuucuacgggcuccagaagcgcgcgcucugccaucgaggaccuucucuuugauaaagugacaaucgcugacccuggguacaugcagggauacgaugacugcaugcagcaaggccccgccuccgcucgggaucugauuugugcccaguauguugccggguacaaggugcugccuccccucauggacgucaacauggaagcugcguauaccagcucccugcuuggaucuaucgccggcgugggguggaccgcuggccugagcuccuucgccgccauuccguuugcucagagcaucuucuacagacucaauggaguuggcauuacacaacaggugcugucugagaaccagaaacugaucgccaauaaguuuaaccaggcgcuuggggcuaugcaaaccggauucacaacgaccaaugaagccuuucggaagguccaggaugccgugaacaacaaugcucaggcccucuccaaacuggcgagcgagcugucuaacacauucggcgcuaucagcgccuccauuggggacaucauucagcgccucgauguucuggaacaagacgcccagaucgauagacuuauuaauggacggcugaccacacucaacgcuuucguggcccagcagcuggucagaucugagagcgcugcccuguccgcgcaacuugccaaggacaaagugaaugagugcgugaaggcucagucuaaacgcagcggcuuuuguggccaggggacccacaucgucuccuucguugugaacgccccuaauggacuguauuuuaugcaugugggcuacuaucccagcaaccacaucgaagucgugucugcuuacgggcucugcgaugccgccaauccuacgaacuguauugcucccguuaauggauacuucaucaagaccaacaauacacggauuguggacgagugguccuauaccggcagcuccuuuuacgcgccggaaccuaucacaucucugaacaccaaguaugucgcuccccaggugacauaccaaaauauuagcaccaaccucccuccuccccugcuugggaacuccacgggaaucgacuuccaggaugagcuggacgaguuuuucaaaaauguuucuacaagcauucccaacuuuggcucccucacccagaucaauaccacacugcuggaucuuaccuaugaaaugcugagccuccaacagguggucaaggcccugaacgagucuuacaucgaccucaaagaacugggcaauuauacguacuacaacaaguggccgugguauauuuggcuuggguucaucgccggacugguggcccucgcucugugcgucuuuuucauucuguguugcacaggcugugggaccaauugcaugggaaaacuuaagugcaacagauguugcgaucgcuacgaggaauaugaccuggagccccauaaagugcacguucacuga

SEQ ID NO: 966 - RNA, 4062 nt, Artificial Sequence
  derived and/or modified CDS sequence (opt5) from MERS-CoV__ALJ54495__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucgugguuagcggauccaccguggcuaugacagagcagcugcagaugggcuuugggaucaccguccaauauggcacggacaccaacucugugugccccaaacuugaguucgccaaugauacaaagauugcgagccagcugggaaacuguguggaauacucccucuauggcguuucugggagaggagucuuucagaauugcaccgcugugggcgugcggcagcaaagauucgucuacgacgccuaucagaaccuggugggguacuauagcgaugacggaaacuacuacugucugcgcgccugcguuuccgugccugucucugugaucuaugauaaggagacaaagacccaugcuacgcuuuuuggcagcguugccugugaacacauuuccagcacaaugucucaguacucccggagcaccagaucuaugcucaaacgccgggacuccacauaugggccccugcagaccccugugggcugcguccugggacucgugaauagcucucuguucguugaggauuguaaacuuccccugggccaaucccucugcgcucugccggacaccccuagcacacugacgcccagauccgugcgcagcguccccggggaaaugcggcuugccucuaucgcguuuaaccacccuauucagguggaucagcucaauagcuccuacuucaagcugucuaucccgaccaacuuuagcuucggagugacacaagaguauauccagaccacaauucagaaggucaccguugacuguaaacaguacgugugcaauggcuuccaaaagugcgaacagcugcucagagaguaugggcaguuuuguuccaagaucaaccaggcccugcauggagcuaaucuucgccaagaugacucugugcggaaccuguucgccagcgucaaauccucucagagcucccccauuaucccuggcuuugggggcgacuucaaucucacgcugcuggagcccgugagcauuucuacaggauccagaagcgcucgcucugccaucgaagaucuucucuuugacaagguuaccaucgcggauccuggcuacaugcagggguacgacgauugcaugcagcaaggacccgccuccgcucgggaccugauuugugcccaguauguggcuggcuacaaaguccugccuccccucauggaugugaacauggaggccgccuauaccagcucccugcuugggucuaucgcuggaguuggcuggacagcggggcugagcuccuucgccgcuauuccguuugcccagagcaucuucuacagacucaauggcgugggaauuacccaacagguccugucugaaaaccagaagcugaucgccaauaaauuuaaccaggcucuuggcgccaugcaaacaggguucacgaccacaaaugaggcguuucggaaggugcaggacgcuguuaacaacaaugcccaggcccucuccaagcuggcuagcgaacugucuaacaccuucggagccaucagcgcguccauuggcgauaucauucagcgccucgacgugcuggagcaagaugcucagaucgacagacuuauuaaugggcggcugacaacccucaacgccuucgucgcccagcagcuggugagaucugagagcgcugcccuguccgcucaacuugccaaagauaaggugaaugaaugcgucaaagcgcagucuaagcgcagcggauuuuguggccagggcauccacaucguuuccuucguggugaacgccccuaaugggcuguauuuuaugcaugucggauacuaucccagcaaccacauugaggugguuucugcuuacggccucugcgacgccgcuaauccuacgaacuguaucgcccccgugaauggguacuucauuaaaaccaacaauacacggaucgucgacgaaugguccuauaccggaagcuccuuuuacgccccggagccuauuacaucucugaacaccaaguauguggcuccccagguuacauaccaaaauaucagcaccaaccucccuccuccccugcuuggcaacuccacggggauugauuuccaggacgagcuggaugaauuuuucaagaaugugucuacaagcauccccaacuuuggaucccucacccagaucaauaccacacugcuggaccuuaccuaugagaugcugagccuccaacaggucgugaaagcgcugaacgaaucuuacauugaucucaaggagcugggcaauuauacguacuacaacaaauggccgugguauaucuggcuuggcuucauugccgggcuggucgcucucgcccugugcguguuuuucauccuguguugcacaggauguggcaccaauugcauggggaaacuuaagugcaacagauguugcgaccgcuacgaagaguaugaucuggagccccauaagguucacgugcacuga

SEQ ID NO: 967 - RNA, 4062 nt, Artificial Sequence
  derived and/or modified CDS sequence (opt5) from MERS-CoV__ALJ54496__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuuccuagcgaugaccggaccgaagucccccagcuggugaacgccaaucaauauuccccguguguuagcauugugccuucuacagucugggaggacggggauuacuaccgcaaacagcucagcccccuggaaggaggcggguggcugguggcuuccggauccaccguugccaugacagagcagcuccagaugggcuuugggaucaccgugcaauauggcacggacaccaacucugucugcccuaagcuggaguucgcgaaugauacaaaaauugcuagccagcuuggaaacuguguggaauacucccuguauggcgugucugggagaggaguuuuucagaauugcaccgccgucggcgugcggcagcaaagauucguguacgacgccuaucagaaccucgucggguacuauagcgaugacggaaacuacuacugucugcgcgcuugcguguccguucccgugucugucaucuaugauaaggagacaaagacccaugccacgcuguuuggcagcguggcuugugaacacauuuccagcacaaugucucaguacucccggagcaccagaucuaugcuuaaacgccgggacuccacauaugggccucuccagacccccguuggcugcgugcugggacuggucaauagcucucucuucguggaggauuguaagcugccgcuuggccaaucccugugcgcccucccugacacccccagcacacugacgcccagauccguucgcagcgugccuggggaaaugcggcuggcgucuaucgccuuuaaccacccgauucaggucgaucagcuuaauagcuccuacuucaaacucucuauccccaccaacuuuagcuucggagugacacaagaguauauccagaccacaauucagaaggugaccgucgacuguaaacaguacguuugcaauggcuuccaaaagugcgaacagcugcugagagaguaugggcaguuuuguuccaagaucaaccaggcucuccauggagccaaucugcgccaagaugacucugugcggaaccuuuucgcuagcgugaaauccucucagagcuccccuauuauccccggcuuugggggcgacuucaaucugacgcuccuggagccugucagcauuucuacaggauccagaagcgcccgcucugcgaucgaagaucugcuuuuugacaaggugaccaucgccgaucccggcuacaugcagggguacgacgauugcaugcagcaaggaccugcuuccgcccgggaccucauuugugcucaguauguugccggcuacaaagugcugcccccgcugauggaugucaacauggaggccgcuuauaccagcucccuccuggggucuaucgcgggagugggcuggacagccgggcuuagcuccuucgcugccauuccuuuugcccagagcaucuucuacagacugaauggcguuggaauuacccaacaggugcucucugaaaaccagaagcugaucgcuaauaaauuuaaccaggcccugggcgcgaugcaaacaggguucacgaccacaaaugaggcuuuucggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuucguggcucagcagcucgucagaucugagagcgccgcucuguccgcccaacuggcgaaagauaaggugaaugaaugcgugaaagcccagucuaagcgcagcggauuuuguggccagggcacgcacaucgucuccuucguugugaacgcucccaaugggcuuuauuuuaugcaugugggauacuauccuagcaaccacaucgaggucgugucugccuacggccugugcgacgcugccaaucccaccaacuguauugccccgguuaauggguacuucaucaaaacaaacaauacccggauuguggacgauugguccuauacaggaagcuccuuuuacgcuccugaacccaucaccucucucaacacaaaguaugucgcgccucaggugaccuaccaaaauauuagcacgaaccugcccccuccccuccugggcaacuccacagggaucgacuuccaggaugagcuugacgaguuuuucaagaauguuucuaccagcauuccgaacuuuggaucccugacccagaucaauacaacccuccuggaucugacguaugaaaugcuuagccugcaacagguggucaaagcccucaacgagucuuacaucgaccugaaggaacucggcaauuauacauacuacaacaaauggcccugguauauuuggcugggcuucaucgcugggcuuguggcccuggcccucugcgucuuuuucauucuguguugcaccggauguggcacaaauugcauggggaagcugaaaugcaacagauguugcgaucgcuacgaggaauaugaccuugagccucauaaggugcacguucacuga

SEQ ID NO: 968 - RNA, 4062 nt, Artificial Sequence
  derived and/or modified CDS sequence (opt5) from MERS-CoV__ALJ54500__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucucccuucugcucagcggcacgcccccucagguguacaacuuuaaacgccugguuuucaccaauuguaacuacaaucuuacaaagcugcucucucuguucuccgugaacgacuuuaccugcagccaaauuucccccgcugcgaucgccucuaauuguuauagcucccugauucucgauuacuucucuuauccccugagcaugaaguccgaccuuagcgucucuuccgcuggcccuaucagccaguuuaacuacaaacagucuuucuccaauccgaccugccugauucucgccacagugccccacaaccugaccacaaucacgaagccucuuaaauauagcuacaucaauaagugcucuagacugcucagcgaugaccggaccgaagucccccagcuggugaacgccaaucaauauuccccuuguguuagcauugugcccucuacagucugggaggacggggauuacuaccgcaaacagcuguccccgcucgaaggaggcggguggcugguggcuagcggauccaccguugccaugacagagcagcuucagaugggcuuugggaucaccgugcaauauggcacggacaccaacucugucugcccuaagcuggaguucgcgaaugauacaaaaauugcuagccagcucggaaacuguguggaauacucccuguauggcgugucugggagaggaguuuuucagaauugcaccgccgucggcgugcggcagcaaagauucguguacgacgccuaucagaaccuggucggguacuauagcgaugacggaaacuacuacugucuucgcgcuugcguguccguucccgugucugucaucuaugauaaggagacaaagacccaugccacgcucuuuggcagcguggcuugugaacacauuuccagcacaaugucucaguacucccggagcaccagaucuaugcugaaacgccgggacuccacauaugggccucugcagacccccguuggcugcgugcucggacuggucaauagcucucuuuucguggaggauuguaagcugccucucggccaaucccugugcgcccugcccgacaccccgagcacacuuacgccuagauccguucgcagcgugcccggggaaaugcggcucgcgucuaucgccuuuaaccaccccauucaggucgaucagcugaauagcuccuacuucaaacugucuaucccuaccaacuuuagcuucggagugacacaagaguauauccagaccacaauucagaaggugaccgucgacuguaaacaguacguuugcaauggcuuccaaaagugcgaacagcuccugagagaguaugggcaguuuuguuccaagaucaaccaggcccuucauggagcuaaucugcgccaagaugacucugugcggaaccucuucgcuagcgugaaauccucucagagcuccccgauuauccccggcuuugggggcgacuucaaucugacgcugcuugagccugucagcauuucuacaggauccagaagcgcccgcucugcgaucgaagaucuccuguuugacaaggugaccaucgccgaucccggcuacaugcagggguacgacgauugcaugcagcaaggaccugcuuccgcccgggaccugauuugugcucaguauguugccggcuacaaagugcuucccccucugauggaugucaacauggaggccgcuuauaccagcucccuucuggggucuaucgcgggagugggcuggacagccgggcucagcuccuucgcugccauucccuuugcccagagcaucuucuacagacugaauggcguuggaauuacccaacaggugcugucugaaaaccagaagcucaucgcuaauaaauuuaaccaggcccucggcgcgaugcaaacaggguucacgaccacaaaugaggcuuuucggaagguccaggacgccgugaacaacaaugcccaggcucuguccaagcuggccagcgaacucucuaacaccuucggagcgaucagcgcuuccauuggcgauaucauucagcgccuggacguucuugagcaagaugcccagaucgacagacugauuaaugggcggcucacaacccugaacgccuucguggcucagcagcuggucagaucugagagcgccgcucuuuccgcccaacuggcgaaagauaaggugaaugaaugcgugaaagcccagucuaagcgcagcggauuuuguggccagggcacgcacaucgucuccuucguugugaacgcuccgaaugggcucuauuuuaugcaugugggauacuauccuagcaaccacaucgaggucgugucugccuacggccugugcgacgcugccaaucccaccaacuguauugccccuguuaauggguacuucaucaaaacaaacaauacccggauuguggacgaaugguccuauacaggaagcuccuuuuacgcucccgagccgaucaccucucucaacacaaaguaugucgcgccucaggugaccuaccaaaauauuagcacgaaccugcccccuccccuucugggcaacuccacagggaucgauuuccaggacgagcucgaugaauuuuucaagaauguuucuaccagcauucccaacuuuggaucccugacccagaucaauacaacccugcuugaccugacguaugagaugcucagccugcaacagguggucaaagcccucaacgaaucuuacaucgaucugaaggagcuuggcaauuauacauacuacaacaaauggccuugguauauuuggcugggcuucaucgcugggcucguggcccuggcccugugcgucuuuuucauucuuuguugcaccggauguggcacaaauugcauggggaagcugaaaugcaacagauguugcgaccgcuacgaagaguaugaucucgagccgcauaaggugcacguucacuga

SEQ ID NO: 969 - RNA, 4062 nt, Artificial Sequence
  derived and/or modified CDS sequence (opt5) from MERS-CoV__ALJ54501__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacacugugggaggacggggauuacuaccgcaaacagcuguccccucucgaaggaggcggguggcuggucgcuagcggauccaccguggccaugacagagcagcuucagaugggcuuugggaucaccguucaauauggcacggacaccaacucugugugccccaagcuggaguucgcgaaugauacaaaaauugcuagccagcucggaaacugugucgaauacucccuguauggcgugucugggagaggaguguuucagaauugcaccgccguuggcguccggcagcaaagauucguguacgacgccuaucagaaccuggugggguacuauagcgaugacggaaacuacuacugucuucgcgcuugcgucuccgugccuguuucugugaucuaugauaaggagacaaagacccaugccacgcucuuuggcagcgucgcuugugaacacauuuccagcacaaugucucaguacucccggagcaccagaucuaugcugaaacgccgggacuccacauaugggccccugcagaccccugugggcugcguucucggacuggugaauagcucucuuuucgucgaggauuguaagcugccccucggccaaucccugugcgcccugccggacaccccuagcacacuuacgcccagauccgugcgcagcguucccggggaaaugcggcucgcgucuaucgccuuuaaccacccuauucagguggaucagcugaauagcuccuacuucaaacugucuaucccgaccaacuuuagcuucggagucacacaagaguauauccagaccacaauucagaaggugaccguggacuguaaacaguacgucugcaauggcuuccaaaagugcgaacagcuccugagagaguaugggcaguuuuguuccaagaucaaccaggcccuucauggagcuaaucugcgccaagaugacucuguucggaaccucuucgcuagcgugaaauccucucagagcucccccauuaucccuggcuuugggggcgacuucaaucugacgcugcuugagcccgugagcauuucuacaggauccagaagcgcccgcucugcgaucgaagaucuccuguuugacaaggucaccaucgccgauccuggcuacaugcagggguacgacgauugcaugcagcaaggacccgcuuccgcccgggaccugauuugugcucaguauguggccggcuacaaaguucucccuccccugauggaugugaacauggaggccgcuuauaccagcucccuucuggggucuaucgcgggagucggcuggacagccgggcucagcuccuucgcugccauuccguuugcccagagcaucuucuacagacugaauggcgugggaauuacccaacagguucugucugaaaaccagaaacuuaucgcuaauaaguuuaaccaggcccucggcgcgaugcaaacaggguucacgaccacaaaugaggcuuuucggaaggugcaggacgccgucaacaacaaugcccaggcucuguccaagcuggccagcgaacucucuaacaccuucggagcgaucagcgcuuccauuggcgauaucauucagcgccuggacgugcuugagcaagaugcccagaucgacagacugauuaaugggcggcucacaacccugaacgccuucguugcucagcagcuggugagaucugagagcgccgcucuuuccgcccaacuggcgaaagauaaggucaaugaaugcgugaaagcccagucuaagcgcagcggauuuuguggccagggcacgcacaucguguccuucgucguuaacgcuccuaaugggcucuauuuuaugcaugugggauacuaucccagcaaccacaucgagguggucucugccuacggccugugcgacgcugccaauccuaccaacuguauugcccccgugaauggguacuucaucaaaacaaacaauacccggauuguugacgaaugguccuauacaggaagcuccuuuuacgcuccggagccuaucaccucucucaacacaaaguauguggcgccccaggucaccuaccaaaauauuagcacgaaccugccuccuccccuucugggcaacuccacagggaucgauuuccaggacgagcucgaugaauuuuucaagaaugugucuaccagcauucccaacuuuggaucccugacccagaucaauacaacccugcuugaccugacguaugagaugcucagccugcaacagguugugaaagcccucaacgaaucuuacaucgaucugaaggagcuuggcaauuauacauacuacaacaaauggccgugguauauuuggcugggcuucaucgcugggcucgucgcccuggcccugugcguguuuuucauucuuuguugcaccggauguggcacaaauugcauggggaagcugaaaugcaacagauguugcgaccgcuacgaagaguaugaucucgagccccauaagguccacgugcacuga

SEQ ID NO: 970 - RNA, 4062 nt, Artificial Sequence
  derived and/or modified CDS sequence (opt5) from MERS-CoV__ALJ54502__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccguucgggaccugauuugugcccaguauguggcuggcuacaaaguccugccuccccucauggaugugaacauggaggccgccuauaccagcucccugcuugggucuaucgcuggaguuggcuggacagcggggcugagcuccuucgccgcuauuccguuugcccagagcaucuucuacagacucaauggcgugggaauuacccaacagguccugucugaaaaccagaagcugaucgccaauaaauuuaaccaggcucuuggcgccaugcaaacaggguucacgaccacaaaugaggcguuucggaaggugcaggacgcuguuaacaacaaugcccaggcccucuccaagcuggcuagcgaacugucuaacaccuucggagccaucagcgcguccauuggcgauaucauucagcgccucgacgugcuggagcaagaugcucagaucgacagacuuauuaaugggcggcugacaacccucaacgccuucgucgcccagcagcuggugagaucugagagcgcugcccuguccgcucaacuugccaaagauaaggugaaugaaugcgucaaagcgcagucuaagcgcagcggauuuuguggccagggcacgcacaucguuuccuucguggugaacgccccuaaugggcuguauuuuaugcaugucggauacuaucccagcaaccacaucgaggugguuucugcuuacggccucugcgacgccgcuaauccuaccaacuguauugcccccgugaauggguacuucaucaaaacaaacaauacccggauugucgacgaaugguccuauacaggaagcuccuuuuacgccccggagccuaucaccucucugaacacaaaguauguggcuccccagguuaccuaccaaaauauuagcacgaaccucccuccuccccugcuuggcaacuccacagggaucgauuuccaggacgagcuggaugaauuuuucaagaaugugucuaccagcauucccaacuuuggaucccucacccagaucaauacaacccugcuggaccuuacguaugagaugcugagccuccaacaggucgugaaagcgcugaacgaaucuuacaucgaucucaaggagcugggcaauuauacauacuacaacaaauggccgugguauauuuggcuuggcuucaucgccgggcuggucgcucucgcccugugcguguuuuucauucuguguugcaccggauguggcacaaauugcauggggaaacuuaaguuuaacagaugcugugaccgcuacgaagaguaugaucuggagccccauaagguucacgugcacuga

SEQ ID NO: 971 - RNA, 4062 nt, Artificial Sequence
  derived and/or modified CDS sequence (opt5) from MERS-CoV__ALJ54512__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggcgcaccucuuuuccucuagauauguggaccuguacggaggcaauauguuccaguuugccacacuuccuguguacgacaccauuaaauauuacagcaucauuccccacuccauccggagcauucagucugaucgcaaggcuugggccgcuuucuaugucuacaaacugcagccgcucacauuucugcuggacuucuccguugauggguauaucagacgggccaucgacugcggauuuaacgaucucagccaacugcauuguucuuacgagagcuucgacguggaauccggcguguauucugucagcuccuuugaggccaagccuagcgggucugugguugaacaggcugagggaguggagugcgauuucagcccccuucuguccggcaccccuccccaggucuacaacuuuaaacgccucguguucacgaauuguaacuacaaucugacaaaacuucugucucucuucuccguuaacgacuuuaccugcagccaaauuucccccgcggccaucgcuucuaauuguuauagcucccugauucuggauuacuucucuuauccucucagcaugaaguccgaccugagcgugucuuccgccggcccgaucagccaguuuaacuacaagcagucuuucuccaauccuaccugccuuauucuggccacagucccccacaaccucaccacaaucacgaagccccugaaauauagcuacaucaauaagugcucuagacuucugagcgaugaccggaccgaagugccucagcucgucaacgcuaaucaauauucccccugugugagcauuguuccgucuacagugugggaggacggggauuacuaccgcaaacagcuguccccucuggaaggaggcggguggcucgucgccagcggauccaccguggcgaugacagagcagcugcagaugggcuuugggaucaccguucaauauggcacggacaccaacucugugugccccaaacuugaguucgcuaaugauacaaagauugccagccagcugggaaacugugucgaauacucccucuauggcgugucugggagaggaguguuucagaauugcaccgccguuggcguccggcagcaaagauucguguacgacgcuuaucagaaccuggugggguacuauagcgaugacggaaacuacuacugucugcgcgccugcgucuccgugccuguuucugugaucuaugauaaggagacaaagacccaugcuacgcuuuuuggcagcgucgccugugaacacauuuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcgcugccggacaccccuagcacacugacgcccagauccgugcgcagcguucccggggaaaugcggcuugccucuaucgcuuuuaaccacccuauucagguggaucagcucaauagcuccuacuucaagcugucuaucccgaccaacuuuagcuucggagucacacaagaguauauccagaccacaauucagaaggugaccguggacuguaaacaguacgucugcaauggcuuccaaaagugcgaacagcugcucagagaguaugggcaguuuuguuccaagaucaaccaggcccugcauggagcuaaucuucgccaagaugacucuguucggaaccuguucgccagcgugaaauccucucagagcucccccauuaucccuggcuuugggggcgacuucaaucucacgcugcuggagcccgugagcauuucuacaggauccagaagcgcgcgcucugccaucgaagaucuucucuuugacaaggucaccaucgcugauccuggcuacaugcagggguacgacgauugcaugcagcaaggacccgccuccgcucgggaccugauuugugcccaguauguggccggcuacaaaguucugccuccccucauggaugugaacauggaggcugcguauaccagcucccugcuugggucuaucgccggagucggcuggacagcugggcugagcuccuucgccgccauuccguuugcucagagcaucuucuacagacucaauggcgugggaauuacccaacagguucugucugaaaaccagaagcugaucgccaauaaauuuaaccaggcgcuuggcgcuaugcaaacaggguucacgaccacaaaugaggccuuucggaaggugcaggacgccgucaacaacaaugcucaggcccucuccaagcuggcgagcgaacugucuaacaccuucggagcuaucagcgccuccauuggcgauaucauucagcgccucgacgugcuggagcaagaugcccagaucgacagacuuauuaaugggcggcugacaacccucaacgcuuucguugcccagcagcuggugagaucugagagcgcugcccuguccgcgcaacuugccaaagauaaggucaaugaaugcgugaaagcucagucuaagcgcagcggauuuuguggccagggcacgcacaucguguccuucgucguuaacgccccuaaugggcuguauuuuaugcaugugggauacuaucccagcaaccacaucgagguggucucugcuuacggccucugcgacgccgccaauccuaccaacuguauugcucccgugaauggguacuucaucaaaacaaacaauacccggauuguugacgaaugguccuauacaggaagcuccuuuuacgcgccggagccuaucaccucucugaacacaaaguauguggcuccccaggucaccuaccaaaauauuagcacgaaccucccuccuccccugcuuggcaacuccacagggaucgauuuccaggacgagcuggaugaauuuuucaagaaugugucuaccagcauucccaacuuuggaucccucacccagaucaauacaacccugcuggaccuuacguaugagaugcugagccuccaacagguugugaaagcccugaacgaaucuuacaucgaucucaaggagcugggcaauuauacauacuacaacaaauggccgugguauauuuggcuuggcuucaucgccgggcuggucgcccucgcucugugcguguuuuucauucuguguugcaccggauguggcacaaauugcauggggaaacuuaagugcaacagauguugcgaccgcuacgaagaguaugaucuggagccccauaagguccacgugcacuga

SEQ ID NO: 972 - RNA, 4062 nt, Artificial Sequence
  derived and/or modified CDS sequence (opt5) from MERS-CoV__ALJ54517__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacgggaacuacuaccgcaaacagcuguccccucuggaaggaggcggguggcucguggcuagcggauccaccguugccaugacagagcagcugcagaugggcuuugggaucaccgugcaauauggcacggauaccaauucugucugccccaaacuugaguucgcgaacgacacaaagauugcuagccagcugggaaauuguguggaauacucccucuauggcgugucugggagaggaguuuuucagaacugcaccgccgucggcgugcggcagcaaagauucguguacgaugccuaucagaaccuggucggguacuauagcgacgauggaaauuacuacugucugcgcgcuugcguguccguuccugugucugucaucuaugacaaggagacaaagacccaugccacgcuuuuuggcagcguggcuugugaacacauuuccagcacaaugucucaguacucccggagcaccagaucuaugcucaaacgccgggauuccacauaugggccccugcagaccccuguuggcugcgugcugggacucgucaacagcucucuguucguggaggacuguaaacuuccccugggccaaucccucugcgcccugccggauaccccuagcacacugacgcccagauccguucgcagcgugcccggggaaaugcggcuugcgucuaucgccuuuaaucacccuauucaggucgaccagcucaacagcuccuacuucaagcugucuaucccgaccaauuuuagcuucggagugacacaagaguauauccagaccacaauucagaaggugaccgucgauuguaaacaguacguuugcaacggcuuccaaaagugcgaacagcugcucagagaguaugggcaguuuuguuccaagaucaaucaggcucugcauggagccaaccuucgccaagacgauucugugcggaaucuguucgcuagcgugaaauccucucagagcucccccauuaucccuggcuuugggggcgacuucaaccucacgcugcuggagcccgucagcauuucuacaggauccagaagcgcccgcucugcgaucgaagaccuucucuuugauaaggugaccaucgccgacccuggcuacaugcagggguacgaugacugcaugcagcaaggacccgcuuccgcccgggaucugauuugugcucaguauguugccggcuacaaagugcugccuccccucauggacgucaauauggaggccgcuuauaccagcucccugcuugggucuaucgcgggagugggcuggacagccgggcugagcuccuucgcugccauuccguuugcccagagcaucuucuacagacucaacggcguuggaauuacccaacaggugcugucugaaaaucagaagcugaucgcuaacaaauuuaaucaggcccuuggcgcgaugcaaacaggguucacgaccacaaacgaggcuuuucggaagguccaggaugccgugaacaauaacgcccaggcucucuccaagcuggccagcgaacugucuaauaccuucggagcgaucagcgcuuccauuggcgacaucauucagcgccucgauguucuggagcaagacgcccagaucgauagacuuauuaacgggcggcugacaacccucaaugccuucguggcucagcagcuggucagaucugagagcgccgcucuguccgcccaacuugcgaaagacaaggugaacgaaugcgugaaagcccagucuaagcgcagcggauuuuguggccagggcacgcacaucgucuccuucguugugaaugcuccuaacgggcuguauuuuaugcaugugggauacuaucccagcaaucacaucgaggucgugucugccuacggccucugcgaugcugccaacccuaccaauuguauugcccccguuaacggguacuucaucaaaacaaauaacacccggauuguggacgaaugguccuauacaggaagcuccuuuuacgcuccggagccuaucaccucucugaauacaaaguaugucgcgccccaggugaccuaccaaaacauuagcacgaaccucccuccuccccugcuuggcaauuccacaagaaucgacuuccaggaugagcuggacgaauuuuucaagaacguuucuaccagcauucccaauuuugggucccucacccagaucaacacaacccugcuggaucuuacguaugagaugcugagccuccaacagguggucaaagcccugaaugaaucuuacaucgaccucaaggagcugggaaacuauacauacuacaauaaauggccgugguauauuuggcuuggcuucaucgcuggccugguggcccucgcccugugcgucuuuuucauucuguguugcaccggguguggaacaaacugcaugggcaaacuuaagugcaaucgcuguugcgauagauacgaagaguaugaccuggagccccauaaggugcacguucacuga

SEQ ID NO: 973 - RNA, 4062 nt, Artificial Sequence
  derived and/or modified CDS sequence (opt5) from MERS-CoV__ALJ54518__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuuccuagcgaugaccggaccgaagucccccagcuggugaacgccaaucaauauuccccguguguuagcauugugccuucuacagucugggaggacggggauuacuaccgcaaacagcucagcccccuggaaggaggcggguggcugguggcuuccggauccaccguugccaugacagagcagcuccagaugggcuuugggaucaccgugcaauauggcacggacaccaacucugucugcccuaagcuggaguucgcgaaugauacaaaaauugcuagccagcuuggaaacuguguggaauacucccuguauggcgugucugggagaggaguuuuucagaauugcaccgccgucggcgugcggcagcaaagauucguguacgacgccuaucagaaccucgucggguacuauagcgaugacggaaacuacuacugucugcgcgcuugcguguccguucccgugucugucaucuaugauaaggagacaaagacccaugccacgcuguuuggcagcguggcuugugaacacauuuccagcacaaugucucaguacucccggagcaccagaucuaugcuuaaacgccgggacuccacauaugggccucuccagacccccguuggcugcgugcugggacuggucaauagcucucucuucguggaggauuguaagcugccgcuuggccaaucccugugcgcccucccugacacccccagcacacugacgcccagauccguucgcagcgugccuggggaaaugcggcuggcgucuaucgccuuuaaccacccgauucaggucgaucagcuuaauagcuccuacuucaaacucucuauccccaccaacuuuagcuucggagugacacaagaguauauccagaccacaauucagaaggugaccgucgacuguaaacaguacguuugcaauggcuuccaaaagugcgaacagcugcugagagaguaugggcaguuuuguuccaagaucaaccaggcucuccauggagccaaucugcgccaagaugacucugugcggaaccuuuucgcuagcgugaaauccucucagagcuccccuauuauccccggcuuugggggcgacuucaaucugacgcuccuggagccugucagcauuucuacaggauccagaagcgcccgcucugcgaucgaagaucugcuuuuugacaaggugaccaucgccgaucccggcuacaugcagggguacgacgauugcaugcagcaaggaccugcuuccgcccgggaccucauuugugcucaguauguugccggcuacaaagugcugcccccgcugauggaugucaacauggaggccgcuuauaccagcucccuccuggggucuaucgcgggagugggcuggacagccgggcuuagcuccuucgcugccauuccuuuugcccagagcaucuucuacagacugaauggcguuggaauuacccaacaggugcucucugaaaaccagaagcugaucgcuaauaaauuuaaccaggcccugggcgcgaugcaaacaggguucacgaccacaaaugaggcuuuucggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuucguggcucagcagcucgucagaucugagagcgccgcucuguccgcccaacuggcgaaagauaaggugaaugaaugcgugaaagcccagucuaagcgcagcggauuuuguggccagggcacgcacaucgucuccuucguugugaacgcucccaaugggcuuuauuuuaugcaugugggauacuauccuagcaaccacaucgaggucgugucugccuacggccugugcgacgcugccaaucccaccaacuguauugccccgguuaauggguacuucaucaaaacaaacaauacccggauuguggacgaaugguccuauacaggaagcuccuuuuacgcuccugagcccaucaccucucucaacacaaaguaugucgcgccucaggugaccuaccaaaauauuagcacgaaccugcccccuccccuccugggcaacuccacagggaucgauuuccaggacgagcuugaugaauuuuucaagaauguuucuaccagcauuccgaacuuuggaucccugacccagaucaauacaacccuccuggaccugacguaugagaugcuuagccugcaacagguggucaaagcccucaacgaaucuuacaucgaucugaaggagcucggcaauuauacauacuacaacaaauggcccugguauauuuggcugggcuucaucgcugggcuuguggcccuggcccucugcgucuuuuucauucuguguugcaccggauguggcacaaauugcauggggaagcugaaaugcaacagauguugcgaccgcuacgaagaguaugaucuugagccucauaaggugcacguucacuga

SEQ ID NO: 974 - RNA, 4062 nt, Artificial Sequence
  derived and/or modified CDS sequence (opt5) from MERS-CoV__ALW82691__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucggagcgaugaccgcaccgaagucccucagcuggugaacgccaaucaauauucccccuguguuagcauugugccgucuacagucugggaggacggggauuacuacagaaaacagcucuccccucuggaaggaggcggguggcugguggcuagcggauccaccguugccaugacagagcagcuccagaugggcuuugggaucaccgugcaauauggcacggacaccaacucugucugccccaagcuggaguucgcgaaugauacaaaaauugcuagccagcuuggaaacuguguggaauacucccuguauggcgugucugggcggggaguuuuucagaauugcaccgccgucggcgugagacagcaacgcuucguguacgacgccuaucagaaccucgucggguacuauagcgaugacggaaacuacuacugucugcgggcuugcguguccguuccugugucugucaucuaugauaaggagacaaagacccaugccacgcuguuuggcagcguggcuugugaacacauuuccagcacaaugucucaguacuccagaagcacccgcucuaugcuuaaacggagagacuccacauaugggccccuccagaccccuguuggcugcgugcugggacuggucaauagcucucucuucguggaggauuguaagcugccccuuggccaaucccugugcgcccucccggacaccccuagcacacugacgccccgcuccguucggagcgugcccggggaaaugagacuggcgucuaucgccuuuaaccacccuauucaggucgaucagcuuaauagcuccuacuucaaacucucuaucccgaccaacuuuagcuucggagugacacaagaguauauccagaccacaauucagaaggugaccgucgacuguaaacaguacguuugcaauggcuuccaaaagugcgaacagcugcugcgcgaguaugggcaguuuuguuccaagaucaaccaggcucuccauggagccaaucugcggcaagaugacucugugagaaaccuuuucgcuagcgugaaauccucucagagcucccccauuaucccuggcuuugggggcgacuucaaucugacgcuccuggagcccgucagcauuucuacaggaucccgcagcgcccggucugcgaucgaagaucugcuuuuugacaaggugaccaucgccgauccuggcuacaugcagggguacgacgauugcaugcagcaaggacccgcuuccgccagagaccucauuugugcucaguauguugccggcuacaaagugcugccuccccugauggaugucaacauggaggccgcuuauaccagcucccuccuggggucuaucgcgggagugggcuggacagccgggcuuagcuccuucgcugccauuccguuugcccagagcaucuucuaccggcugaauggcguuggaauuacccaacaggugcucucugaaaaccagaagcugaucgcuaauaaauuuaaccaggcccugggcgcgaugcaaacaggguucacgaccacaaaugaggcuuuucgcaagguccaggacgccgugaacaacaaugcccaggcucuuuccaagcucgccagcgaacugucuaacaccuucggagcgaucagcgcuuccauuggcgauaucauucagagacuggacguucucgagcaagaugcccagaucgaccggcugauuaaugggagacuuacaacccugaacgccuucguggcucagcagcucguccgcucugagagcgccgcucuguccgcccaacuggcgaaagauaaggugaaugaaugcgugaaagcccagucuaagcggagcggauuuuguggccagggcacgcacaucgucuccuucguugugaacgcuccuaaugggcuuuauuuuaugcaugugggauacuaucccagcaaccacaucgaggucgugucugccuacggccugugcgacgcugccaauccuaccaacuguauugcccccguuaauggguacuucaucaaaacaaacaauaccagaauuguggacgaaugguccuauacaggaagcuccuuuuacgcuccggagccuaucaccucucucaacacaaaguaugucgcgccccaggugaccuaccaaaauauuagcacgaaccugccuccuccccuccugggcaacuccacagggaucgauuuccaggacgagcuugaugaauuuuucaagaauguuucuaccagcauucccaacuuuggaucccugacccagaucaauacaacccuccuggaccugacguaugagaugcuuagccugcaacagguggucaaagcccucaacgaaucuuacaucgaucugaaggagcucggcaauuauacauacuacaacaaauggccgugguauauuuggcugggcuucaucgcugggcuuguggcccuggcccucugcgucuuuuucauucuguguugcaccggauguggcacaaauugcauggggaagcugaaaugcaaccgcuguugcgacagauacgaagaguaugaucuugagccccauaaggugcacguucacuga

SEQ ID NO: 975 - RNA, 4062 nt, Artificial Sequence
  derived and/or modified CDS sequence (opt5) from MERS-CoV__ALW82742__S
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccauccagaaaauuuacccugccuucaugcuggggucuuccgugggaaacuuuagcgauggcaagauggggagauucuuuaaucauacacuuguccugcucccggacggauguggcacccugcugcgggcguucuacugcauccucgagccccgcucugggaaccacuguccugccggaaauuccuauacgagcuuugcuacauaccauacccccgccacagauugcucugacggcaacuauaauagaaacgcuucccugaauagcuucaaggaauacuucaaccuucggaauuguaccuuuauguauaccuacaacauuacagaggaugaaauccuggagugguucggcaucacgcaaaccgcccagggggugcaccucuuuuccucucgcuauguggaccuguacggaggcaauauguuccaguuugcgacacuuccugucuacgacaccauuaaauauuacagcaucauuccccacuccaucagaagcauucagucugaucggaaggccugggcugccuucuauguuuacaaacugcaaccgcucacauuucugcuggacuucuccguggauggguauauccgcagagcuaucgacugcggauuuaacgaucucagccagcugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccaaguguacaacuuuaaacggcucguuuucacgaauuguaacuacaaucugacaaaacuucugucucucuucuccgugaacgacuuuaccugcagccagauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucucgccuucugagcgaugacagaaccgaagucccucaacucgugaacgccaaucaguauucccccuguguuagcauugugccgucuacagucugggaggacggggauuacuaccggaaacagcuguccccucuggaaggaggcggguggcucguggcuagcggauccaccguugccaugacagagcagcugcaaaugggcuuugggaucaccgugcaguauggcacggacaccaacucugucugccccaaacuugaguucgcgaaugauacaaagauugcuagccagcugggaaacuguguggaauacucccucuauggcgugucugggcgcggaguuuuucagaauugcaccgccgucggcgugagacaacagcgguucguguacgacgccuaucagaaccuggucggguacuauagcgaugacggaaacuacuacugucugagagcuugcguguccguuccugugucugucaucuaugauaaggagacaaagacccaugccacgcuuuuuggcagcguggcuugugaacacauuuccagcacaaugucucaguacucccgcagcacccggucuaugcucaaaagacgcgacuccacauaugggccccugcaaaccccuguuggcugcgugcugggacucgucaauagcucucuguucguggaggauuguaaacuuccccugggccagucccucugcgcccugccggacaccccuagcacacugacgccccgguccguuagaagcgugcccggggaaaugcgccuugcgucuaucgccuuuaaccacccuauucaggucgaucaacucaauagcuccuacuucaagcugucuaucccgaccaacuuuagcuucggagugacacaggaguauauccagaccacaauucagaaggugaccgucgacuguaaacaauacguuugcaauggcuuccagaagugcgaacagcugcuccgggaguaugggcaguuuuguuccaagaucaaccaagcucugcauggagccaaucuuagacaggaugacucugugcgcaaccuguucgcuagcgugaaauccucucagagcucccccauuaucccuggcuuugggggcgacuucaaucucacgcugcuggagcccgucagcauuucuacaggaucccggagcgccagaucugcgaucgaagaucuucucuuugacaaggugaccaucgccgauccuggcuacaugcagggguacgacgauugcaugcaacagggacccgcuuccgcccgcgaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccaaagcaucuucuaccggcucaauggcguuggaauuacccaacaggugcugucugaaaaccagaagcugaucgcuaauaaauuuaaccaggcccuuggcgcgaugcagacaggguucacgaccacaaaugaggcuuuuagaaagguccaggacgccgugaacaacaaugcccaggcucucuccaagcuggccagcgaacugucuaacaccuucggagcgaucagcgcuuccauuggcgauaucauucaacggcucgacguucuggagcaggaugcccagaucgaccgccuuauuaaugggagacugacaacccucaacgccuucguggcucagcaacugguccggucugagagcgccgcucuguccgcccagcuugcgaaagauaaggugaaugaaugcgugaaagcccagucuaagagaagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccgcauuguggacgaaugguccuauacaggaagcuccuuuuacgcuccggagccuaucaccucucugaacacaaaguaugucgcgccccaagugaccuaccagaauauuagcacgaaccucccuccuccccugcuuggcaacuccacagggaucgauuuccaggacgagcuggaugaauuuuucaagaauguuucuaccagcauucccaacuuuggaucccucacccaaaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaagugcaaccgguguugcgacagauacgaagaguaugaucuggagccccauaaggugcacguucacuga

SEQ ID NO: 976 - RNA, 4062 nt, Artificial Sequence
  derived and/or modified CDS sequence (opt5) from MERS-CoV__ALW82753__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccucuacagauugcuccgacggcaacuauaaucggaacgccagccuuaauuccuucaaggaauacuucaaccuucgcaauuguaccuuuauguauaccuacaacauuacagaggaugaaauccuggagugguucggcaucacgcagaccgcucaaggggugcaccucuuuucuagcagauauguggaccuguacggaggcaauauguuccaguuugccacacuuccugucuacgacaccauuaaauauuacuccaucauuccccacagcauccggucuauucaguccgaucgcaaggcgugggccgcuuucuauguuuacaaacugcagccgcucacauuucugcuggacuucagcguggauggguauaucagacgggccaucgacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcaccccuccccagguguacaacuuuaaacgccucguuuucacgaauuguaacuacaaucugacaaagcugcugucccucuucagcgugaacgacuuuaccugcucccaaauuucucccgccgcuaucgcgagcaauuguuauuccucucugauucuggauuacuucagcuauccucucuccaugaaaagcgaccugucugucuccagcgccggcccgaucucucaguuuaacuacaagcaguccuucagcaauccuaccugccuuauucuggcuacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggagaggaguuuuucagaauugcaccgcugucggcgugcggcagcaaagauucguguacgacgccuaucagaaccuggucggguacuauuccgaugacggaaacuacuacugucugcgcgccugcgugucuguuccugugagcgucaucuaugauaaggagacaaagacccaugcuacgcuuuuuggcuccguggccugugaacacauuagcucuacaaugucccaguacagccggucuaccagauccaugcucaaacgccgggacagcacauaugggccccugcagaccccuguuggcugcgugcugggacucgucaauucuucccuguucguggaggauuguaaacuuccccugggccaaagccucugcgcucugccggacaccccuuccacacugacgcccagaagcguucgcucugugcccggggaaaugcggcuugccagcaucgcguuuaaccacccuauucaggucggacagcucaauuccucuuacuucaagcugagcaucccgaccaacuuuuccuucggcgugacacaagaguauauccagaccacaauucagaaggugaccgucgauuguaaacaguacguuugcaauggguuccaaaagugcgaacagcugcucagagaguauggacaguuuuguucuaagaucaaccaggcccugcauggcgcuaaucuucgccaagacgauagcgugcggaaccuguucgccuccgugaaaucuagccaguccagccccauuaucccuggguuuggcggagacuucaaucucacgcugcuggagcccgucucuauuuccacaggcagcagaucugcucgcuccgccaucgaagaccuucucuuugauaaggugaccaucgcggacccuggguacaugcagggauacgaugacugcaugcagcaaggccccgccagcgcucgggaucugauuugugcccaguauguugcuggguacaaagugcugccuccccucauggacgucaacauggaggccgccuauaccuccucucugcuuggaagcaucgcuggcgugggguggacagcgggccuguccagcuucgccgcuauuccguuugcccagucuaucuucuacagacucaauggaguuggcauuacccaacaggugcuguccgaaaaccagaagcugaucgccaauaaauuuaaccaggcucuuggggccaugcaaacaggauucacgaccacaaaugaggcguuucggaagguccaggaugcugugaacaacaaugcccaggcccucagcaagcuggcuucugaacugagcaacaccuucggcgccaucuccgcgucuauuggggacaucauucagcgccucgauguucuggagcaagacgcucagaucgauagacuuauuaauggacggcugacaacccucaacgccuucguggcccagcagcuggucagaagcgaguccgcugcccugucugcucaacuugccaaagacaaggugaaugaaugcgugaaagcgcagagcaagcgcuccggcuuuuguggccaggggacgcacaucgucagcuucguugugaacgccccuaauggacuguauuuuaugcaugugggcuacuaucccucuaaccacaucgaggucguguccgcuuacgggcucugcgaugccgcuaauccuaccaacuguauugcccccguuaauggauacuucaucaaaacaaacaauacccggauuguggacgaauggagcuauacaggcuccucuuuuuacgccccggagccuaucaccagccugaacacaaaguaugucgcuccccaggugaccuaccaaaauauuuccacgaaccucccuccuccccugcuuucuaacagcacagggaucgacuuccaggaugagcuggacgaauuuuucaagaauguuuccaccagcauucccaacuuuggaucucucacccagaucaauacaacccugcuggaucuuacguaugagaugcugucccuccaacagguggucaaagcgcugaacgaaagcuacaucgaccucaaggagcugggcaauuauacauacuacaacaaauggccgugguauauuuggcuuggcuucaucgccgggcugguggcucucgcccugugcgucuuuuucauucuguguugcaccggauguggcacaaauugcauggggaaacuuaagugcaacagauguugcgaucgcuacgaagaguaugaccuggagccccauaaggugcacguucacuga

SEQ ID NO: 977 - RNA, 4062 nt, Artificial Sequence
  derived and/or modified CDS sequence (opt5) from MERS-CoV__ALX27228__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucuggaaagacggggauuacuaccgcaagcagcuguccccucuggagggaggcggguggcucguggcuagcggauccaccguugccaugacagaacagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaaaacccaugccacgcuuuuuggcagcguggcuugugagcacauuuccagcacaaugucucaguacucccggagcaccagaucuaugcucaagcgccgggacuccacauaugggccccugcagaccccuguuagcugcgugcugggccucgucaauucuucccuguucguggaagauuguaaacuuccccugggacaaagccucugcgcccugccggacaccccuuccacacugacgcccagaagcguucgcucugugcccggcgagaugcggcuugcgagcaucgccuuuaaccacccuauucaggucgaucagcucaauuccucuuacuucaagcugagcaucccgaccaacuuuuccuucggggugacacaagaauauauccagaccacaauucagaaagugaccgucgacuguaagcaguacguuugcaauggauuccaaaagugcgagcagcugcucagagaauauggccaguuuuguucuaaaaucaaccaggcucugcauggggccaaucuucgccaagaugacagcgugcggaaccuguucgcuuccgugaagucuagccaguccagccccauuaucccuggauuuggcggggacuucaaucucacgcugcuggagcccgucucuauuuccacaggcagcagaucugcccgcuccgcgaucgaggaucuucucuuugacaaagugaccaucgccgauccuggauacaugcagggcuacgacgauugcaugcagcaagggcccgcuagcgcccgggaccugauuugugcucaguauguugccggauacaaggugcugccuccccucauggaugucaacauggaagccgcuuauaccuccucucugcuuggcagcaucgcgggggugggauggacagccggccuguccagcuucgcugccauuccguuugcccagucuaucuucuacagacucaaugggguuggcauuacccaacaggugcuguccgagaaccagaaacugaucgcuaauaaguuuaaccaggcccuuggagcgaugcaaacaggcuucacgaccacaaaugaggcuuuucggaagguccaggacgccgugaacaacaaugcccaggcucucagcaaacuggccucugaacugagcaacaccuucggggcgaucuccgcuucuauuggagauaucauucagcgccucgacguucuggaacaagaugcccagaucgacagacuuauuaauggccggcugacaacccucaacgccuucguggcucagcagcuggucagaagcgaguccgccgcucugucugcccaacuugcgaaggauaaagugaaugagugcgugaaggcccagagcaaacgcuccggguuuuguggacagggcacgcacaucgucagcuucguugugaacgcuccuaauggccuguauuuuaugcaugugggguacuaucccucuaaccacaucgaagucguguccgccuacggacucugcgacgcugccaauccuaccaacuguauugcccccguuaauggcuacuucaucaagacaaacaauacccggauuguggacgaguggagcuauacaggguccucuuuuuacgcuccggaaccuaucaccagccugaacacaaaguaugucgcgccccaggugaccuaccaaaauauuuccacgaaccucccuccuccccugcuuggaaacucuacaggcaucgauuuccaggacgagcuggaugaguuuuucaaaaauguuagcaccuccauucccaacuuugggagccucacccagaucaauacaacccugcuggaccuuacguaugaaaugcugucucuccaacagguggucaaggcccugaacgaguccuacaucgaucucaaagaacugggaaauuauacauacuacaacaaguggccgugguauauuuggcuuggcuucaucgcuggccugguggcccucgcccugugcgucuuuuucauucuguguugcaccggguguggaacaaauugcaugggcaaacuuaagugcaacagauguugcgaccgcuacgaggaauaugaucuggagccccauaaagugcacguucacuga

SEQ ID NO: 978 - RNA, 4062 nt, Artificial Sequence
  derived and/or modified CDS sequence (opt5) from MERS-CoV__ALX27232__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcuacggcaagauggggcgguucuuuaaucauacacuuguccugcucccggauggauguggcacccugcugcgcgcguucuauugcauccucgagcccagaucugggaaccacuguccugccggaaauuccuacacgagcuuugcuacauaucauacccccgccacagacugcucugauggcaacuacaaucggaacgcuucccugaauagcuucaaggaauauuucaaccuucgcaauuguaccuuuauguacaccuauaacauuacagaggacgaaauccuggagugguucggcaucacgcagaccgcccaaggggugcaccucuuuuccucuagauacguggaucuguacggaggcaauauguuccaguuugcgacacuuccugucuaugacaccauuaaauacuauagcaucauuccccacuccauccggagcauucagucugaccgcaaggccugggcugccuucuacguuuauaaacugcagccgcucacauuucugcuggauuucuccguggacggguacaucagacgggcuaucgauugcggauuuaacgaccucagccaacugcauuguucuuaugagagcuucgauguggaauccggcgucuacucugugagcuccuuugaggccaagccuagcgggucuguuguggaacaggccgagggagucgagugcgacuucagcccccuucuguccggcaccccuccccagguguacaacuuuaaacgccucguuuucacgaauuguaacuauaaucugacaaaacuucugucucucuucuccgugaacgauuuuaccugcagccaaauuucccccgcugcgaucgccucuaauuguuacagcucccugauucuggacuauuucucuuacccucucagcaugaaguccgaucugagcgucucuuccgcuggcccgaucagccaguuuaacuauaagcagucuuucuccaauccuaccugccuuauucuggccacagugccccacaaccucaccacaaucacgaagccccugaaauacagcuauaucaauaagugcucuagacuucugagcgacgaucggaccgaagucccucagcucgugaacgccaaucaauacucccccuguguuagcauugugccgucuacagucugggaggacggggacuacuaucgcaaacagcuguccccucuggaaggaggcggguggcucguggcuagcggauccaccguugccaugacagagcagcugcagaugggcuuugggaucaccgugcaauacggcacggauaccaacucugucugccccaaacuugaguucgcgaaugacacaaagauugcuagccagcugggaaacuguguggaauauucccucuacggcgugucugggagaggaguuuuucagaauugcaccgccgucggcgugcggcagcaaagauucguguaugaugccuaccagaaccuggucggguauuacagcgacgauggaaacuacuauugucugcgcgcuugcguguccguuccugugucugucaucuacgacaaggagacaaagacccaugccacgcuuuuuggcagcguggcuugugaacacauuuccagcacaaugucucaguauucccggagcaccagaucuaugcucaaacgccgggauuccacauacgggccccugcagaccccuguuggcugcgugcugggacucgucaauagcucucuguucguggaggacuguaaacuuccccugggccaaucccucugcgcccugccggauaccccuagcacacugacgcccagauccguucgcagcgugcccggggaaaugcggcuugcgucuaucgccuuuaaccacccuauucaggucgaccagcucaauagcuccuauuucaagcugucuaucccgaccaacuuuagcuucggagugacacaagaguacauccagaccacaauucagaaggugaccgucgauuguaaacaguauguuugcaauggcuuccaaaagugcgaacagcugcucagagaguacgggcaguuuuguuccaagaucaaccaggcucugcauggagccaaucuucgccaagacgauucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaccuucucuuugauaaggugaccaucgccgacccuggcuacaugcagggguaugaugacugcaugcagcaaggacccgcuuccgcccgggaucugauuugugcucaguacguugccggcuauaaagugcugccuccccucauggacgucaacauggaggccgcuuacaccagcucccugcuugggucuaucgcgggagugggcuggacagccgggcugagcuccuucgcugccauuccguuugcccagagcaucuucuauagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggaugccgugaacaacaaugcccaggcucucuccaagcuggccagcgaacugucuaacaccuucggagcgaucagcgcuuccauuggcgacaucauucagcgccucgauguucuggagcaagacgcccagaucgauagacuuauuaaugggcggcugacaacccucaacgccuucguggcucagcagcuggucagaucugagagcgccgcucuguccgcccaacuugcgaaagacaaggugaaugaaugcgugaaagcccagucuaagcgcagcggauuuuguggccagggcacgcacaucgucuccuucguugugaacgcuccuaaugggcuguacuuuaugcaugugggauauuaccccagcaaccacaucgaugucgugucugccuacggccucugcgacgcugccaauccuaccaacuguauugcccccguuaauggguauuucaucaaaacaaacaauacccggauuguggacgagugguccuacacaggaagcuccuuuuaugcuccggaaccuaucaccucucugaacacaaaguacgucgcgccccaggugaccuaucaaaauauuagcacgaaccucccuccuccccugcuuggcaacuccacagggaucgauuuccaggacgagcuggaugaguuuuucaagaauguuucuaccagcauucccaacuuuggaucccucacccagaucaauacaacccugcuggaccuuacguacgaaaugcugagccuccaacagguggucaaagcccugaacgagucuuauaucgaucucaaggaacugggcaauuacacauacuauaacaaauggccgugguacauuuggcuuggcuucaucgcugggcugguggcccucgcccugugcgucuuuuucauucuguguugcaccggauguggcacaaauugcauggggaaacuuaagugcaacagauguugcgaccgcuaugaggaauacgaucuggagccccauaaggugcacguucacuga

SEQ ID NO: 979 - RNA, 4062 nt, Artificial Sequence
  derived and/or modified CDS sequence (opt5) from MERS-CoV__AMQ48993__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaucguugccaugaccgagcagcugcagaugggcuuugggauuacagugcaauauggcaccgacacgaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacacaugccacccuuuuuggcagcguggcuugugaacacaucuccagcacgaugucucaguacucccggagcacaagaucuaugcucaaacgccgggacuccaccuaugggccccugcagacaccuguuggcugcgugcugggacucgucaauagcucucuguucguggaggauuguaaacuuccccugggccaaucccucugcgcccugccggacaccccuagcacccugacacccagauccguucgcagcgugcccggggaaaugcggcuugcgucuauugccuuuaaccacccuauccaggucgaucagcucaauagcuccuacuucaagcugucuaucccgacgaacuuuagcuucggagugacccaagaguauauucagacaaccauccagaaggugacagucgacuguaaacaguacguuugcaauggcuuccaaaagugcgaacagcugcucagagaguaugggcaguuuuguuccaagauuaaccaggcucugcauggagccaaucuucgccaagaugacucugugcggaaccuguucgcuagcgugaaauccucucagagcucccccaucauuccuggcuuugggggcgacuucaaucucacccugcuggagcccgucagcaucucuacgggauccagaagcgcccgcucugcgaucgaagaucuucucuuugacaaggugacaauugccgauccuggcuacaugcagggguacgacgauugcaugcagcaaggacccgcuuccgcccgggaccugaucugugcucaguauguugccggcuacaaagugcugccuccccucauggaugucaacauggaggccgcuuauaccagcucccugcuugggucuauugcgggagugggcuggaccgccgggcugagcuccuucgcugccaucccguuugcccagagcauuuucuacagacucaauggcguuggaaucacacaacaggugcugucugaaaaccagaagcugaucgcuaauaaauuuaaccaggcccuuggcgcgaugcaaaccggguucacaacgaccaaugaggcuuuucggaagguccaggacgccgugaacaacaaugcccaggcucucuccaagcuggccagcgaacugucuaacacauucggagcgauuagcgcuuccaucggcgauauuauccagcgccucgacguucuggagcaagaugcccagauugacagacuuaucaaugggcggcugaccacacucaacgccuucguggcucagcagcuggucagaucugagagcgccgcucuguccgcccaacuugcgaaagauaaggugaaugaaugcgugaaagcccagucuaagcgcagcggauuuuguggccagggcacccacaucgucuccuucguugugaacgcuccuaaugggcuguauuuuaugcaugugggauacuaucccagcaaccacauugaggucgugucugccuacggccucugcgacgcugccaauccuacgaacuguaucacccccguuaauggguacuucauuaaaacaaacaauacccggaucguggacgaaugguccuauacaggaagcuccuuuuacgccccggagccuauuaccucucugaacacaaaguaugucgcuccccaggugaccuaccaaaauaucagcacgaaccucccuccuccccugcuuuccaacucuacaggcauugauuuccaggacgagcuggaugaauuuuucaagaauguuagcaccuccauccccaacuuugggagccucacccagaucaauacaacccugcuggaccuuacguaugagaugcugucucuccaacagguggucaaagcgcugaacgaauccuacauugaucucaaggagcugggaaauuauacauacuacaacaaauggccgugguauaucuggcuuggcuucauugccggccugguggcucucgcccugugcgucuuuuucauccuguguugcaccggguguggaacaaauugcaugggcaaacuuaagugcaacagauguugcgaccgcuacgaagaguaugaucuggagccccauaaggugcacguucacuga

SEQ ID NO: 980 - RNA, 4062 nt, Artificial Sequence
  derived and/or modified CDS sequence (opt5) from MERS-CoV__AMW90844__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccuuccaauauggcacggacaccaacucugugugccccaaacuugaauuugcgaaugauacaaagauugcuagccagcugggaaacugugucgaguacucccucuauggcgugucugggagaggaguguuccagaauugcaccgccguuggcguccggcagcaaagauuuguguacgacgccuaucagaaccuggugggguacuauagcgaugacggaaacuacuacugucugcgcgcuugcgucuccgugccuguuucugugaucuaugauaaggagacaaagacccaugccacgcuuuucggcagcgucgcuugugaacacauuuccagcacaaugucucaguacucccggagcaccagaucuaugcucaaacgccgggacuccacauaugggccccugcagaccccugugggcugcguucugggacucgugaauagcucucuguuugucgaggauuguaaacuuccccugggccaaucccucugcgcccugccggacaccccuagcacacugacgcccagauccgugcgcagcguucccggggaaaugcggcuugcgucuaucgccuucaaccacccuauucagguggaucagcucaauagcuccuacuuuaagcugucuaucccgaccaacuucagcuucggagucacacaagaguauauccagaccacaauucagaaggugaccguggacuguaaacaguacgucugcaauggcuuucaaaagugcgaacagcugcucagagaguaugggcaguucuguuccaagaucaaccaggcucugcauggagccaaucuucgccaagaugacucuguucggaaccuguuugcuagcgugaaauccucucagagcucccccauuaucccuggcuucgggggcgacuuuaaucucacgcugcuggagcccgugagcauuucuacaggauccagaagcgcccgcucugcgaucgaagaucuucucuucgacaaggucaccaucgccgauccuggcuacaugcagggguacgacgauugcaugcagcaaggacccgcuuccgcccgggaccugauuugugcucaguauguggccggcuacaaaguucugccuccccucauggaugugaacauggaggccgcuuauaccagcucccugcuugggucuaucgcgggagucggcuggacagccgggcugagcuccuuugcugccauuccguucgcccagagcaucuuuuacagacucaauggcgugggaauuacccaacagguucugucugaaaaccagaagcugaucgcuaauaaauucaaccaggcccuuggcgcgaugcaaacaggguuuacgaccacaaaugaggcuuuccggaaggugcaggacgccgucaacaacaaugcccaggcucucuccaagcuggccagcgaacugucuaacaccuucggagcgaucagcgcuuccauuggcgauaucauucagcgccucgacgugcuggagcaagaugcccagaucgacagacuuauuaaugggcggcugacaacccucaacgccuuuguugcucagcagcuggugagaucugagagcgccgcucuguccgcccaacuugcgaaagauaaggucaaugaaugcgugaaagcccagucuaagcgcagcggauucuguggccagggcacgcacaucguguccuuugucguuaacgcuccuaaugggcuguauuucaugcaugugggauacuaucccagcaaccacaucgagguggucucugccuacggccucugcgacgcugccaauccuaccaacuguauugcccccgugaauggguacuuuaucaaaacaaacaauacccggauuguugacgaaugguccuauacaggaagcuccuucuacgcuccggagccuaucaccucucugaacacaaaguauguggcgccccaggucaccuaccaaaauauuagcacgaaccucccuccuccccugcuuggcaacuccacagggaucgauuuucaggacgagcuggaugaguucuuuaagaaugugucuaccagcauucccaacuucggaucccucacccagaucaauacaacccugcuggaccuuacguaugaaaugcugagccuccaacagguugugaaagcccugaacgaaucuuacaucgaucucaaggagcugggcaauuauacauacuacaacaaauggccgugguauauuuggcuuggcuuuaucgcugggcuggucgcccucgcccugugcguguucuuuauucuguguugcaccggauguggcacaaauugcauggggaaacuuaagugcaacagauguugcgaccgcuacgaagaguaugaucuggagccccauaagguccacgugcacuga

SEQ ID NO: 981 - RNA, 4062 nt, Artificial Sequence
  derived and/or modified CDS sequence (opt5) from MERS-CoV__AMW90852__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccagauccguucgcagcgugcccggggaaaugcggcuggcgucuaucgccuucaaccacccuauucaggucgaucagcuuaauagcuccuacuuuaaacucucuaucccgaccaacuucagcuucggagugacacaagaguauauccagaccacaauucagaaggugaccgucgacuguaaacaguacguuugcaauggcuuucaaaagugcgaacagcugcugagagaguaugggcaguucuguuccaagaucaaccaggcucuccauggagccaaucugcgccaagaugacucugugcggaaccuuuuugcuagcgugaaauccucucagagcucccccauuaucccuggcuucgggggcgacuuuaaucugacgcuccuggagcccgucagcauuucuacaggauccagaagcgcccgcucugcgaucgaagaucugcuuuucgacaaggugaccaucgccgauccuggcuacaugcagggguacgacgauugcaugcagcaaggacccgcuuccgcccgggaccucauuugugcucaguauguugccggcuacaaagugcugccuccccugauggaugucaacauggaggccgcuuauaccagcucccuccuggggucuaucgcgggagugggcuggacagccgggcuuagcuccuuugcugccauuccguucgcccagagcaucuuuuacagacugaauggcguuggaauuacccaacaggugcucucugaaaaccagaagcugaucgcuaauaaauucaaccaggcccugggcgcgaugcaaacaggguuuacgaccacaaaugaggcuuuccggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuuuguggcucagcagcucgucagaucugagagcgccgcucuguccgcccaacuggcgaaagauaaggugaaugaaugcgugaaagcccagucuaagcgcagcggauucuguggccagggcacgcacaucgucuccuuuguugugaacgcuccuaaugggcuuuauuucaugcaugugggauacuaucccagcaaccacaucgaggucgugucugccuacggccugugcgacgcugccaauccuaccaacuguauugcccccguuaauggguacuuuaucaaaacaaacaauacccggauuguggacgaaugguccuauacaggaagcuccuucuacgcuccggagccuaucaccucucucaacacaaaguaugucgcgccccaggugaccuaccaaaauauuagcacgaaccugccuccuccccuccugggcaacuccacagggaucgauuuucaggacgagcuugaugacuucuuuaagaauguuucuaccagcauucccaacuucggaucccugacccagaucaauacaacccuccuggaucugacguaugaaaugcuuagccugcaacagguggucaaagcccucaacgagucuuacaucgaccugaaggaacucggcaauuauacauacuacaacaaauggccgugguauauuuggcugggcuuuaucgcugggcuuguggcccuggcccucugcgucuucuuuauucuguguugcaccggauguggcacaaauugcauggggaagcugaaaugcaacagauguugcgaucgcuacgaggaauaugaccuugagccccauaaggugcacguucacuga

SEQ ID NO: 982 - RNA, 4062 nt, Artificial Sequence
  derived and/or modified CDS sequence (opt5) from MERS-CoV__AMW90853__S
augauccacagcguguuccugcucauguuucugcuuacccccacagaguccuacgucgacguuggcucugauagcgugaaguccgccugcauugaaguggacauccagcaaacguucuuugauaaaaccuggccuagaccgauugacgucucuaaggcugaugggaucauuuauccccagggacggacauacagcaacaucaccaucacauaucagggccuguucccuuaccagggggaccauggagauauguauguguacuccgccggcuaugcgaccgggacaacgccccaaaaacucuuuguugcuaauuacucucaggacgugaagcaguucgccaacggauuugucgugcgcauuggcgccgcugccaauagcaccggcaccguuaucauuuccccuagcacaucugcuaccaucagaaaaauuuaccccgccuucaugcugggguccagcgugggaaacuuuucugauggcaagauggggcgguucuuuaaucacacacuuguccugcucccugacggauguggcacccugcugcgcgcguucuauugcauccucgagccgagauccgggaaccauugucccgccggaaauagcuacacgucuuuugcuacauaucacaccccugccacagauugcuccgacggcaacuacaaucggaacgcuagccugaauagcuucaaggaauauuucaaccuucgcaauuguaccuuuauguacaccuauaacauuacagaggaugaaauccuggagugguucggcaucacgcagaccgcccaaggggugcaucucuuuucuagcagauacguggaccuguacggaggcaauauguuccaguuugcgacacuucccgucuaugacaccauuaaauacuauuccaucauuccucacagcauccggucuauucaguccgaucgcaaggccugggcugccuucuacguuuauaaacugcagccccucacauuucugcuggacuucagcguggauggguacaucagacgggcuaucgacugcggauuuaacgaucucucucaacugcacuguagcuaugaguccuucgacguggaaucuggcgucuacagcguguccagcuuugaggccaagccgucuggguccguuguggaacaggccgagggagucgagugcgauuucagcccucuucugucuggcacgcccccucagguguacaacuuuaaacgccucguuuucaccaauuguaacuauaauuucacaaagcugcuuucccuguuuagcgugaacgacuuuaccugcucccaaauuucucccgcugcgaucgccagcaauuguuacuccucucucauucuggauuauuucagcuacccccuguccaugaaguccgaccucucugucuccagcgcuggcccuaucucucaguucaacuauaaacaguccuuuagcaauccgaccugccugauucuugccacagugccccauaaccugaccacaaucacgaagccucucaaauacucuuauaucaauaagugcagcagacugcuuuccgaugaccggaccgaagucccccagcuggugaacgccaaucaauacagcccuuguguuucuauugugcccuccacagucugggaggacggggauuacuaucgcaaacagcucagcccgcuggaaggaggcggguggcugguggcuuccggaucuaccguugccaugacagagcagcuccagaugggcuucgggaucaccgugcaauacggcacggacaccaacagcgucugcccuaagcuggaauuugcgaaugauacaaaaauugcuucccagcuuggaaacuguguggaguauucucuguacggcgugagcgggagaggaguuuuccagaauugcaccgccgucggcgugcggcagcaaagauuuguguaugacgccuaccagaaccucgucggguauuacuccgaugacggaaacuacuauugucugcgcgcuugcgugucuguucccgugagcgucaucuacgauaaggagacaaagacccacgccacgcuguucggcuccguggcuugugaacauauuagcucuacaaugucccaguauagccggucuaccagauccaugcuuaaacgccgggacagcacauacgggccucuccagacccccguuggcugcgugcugggacuggucaauucuucccucuuuguggaggauuguaagcugccucuuggccaaagccugugcgcccuccccgacaccccguccacacugacgccuagaagcguucgcucugugcccggggaaaugcggcuggcgagcaucgccuucaaccaccccauucaggucgaucagcuuaauuccucuuauuuuaaacucagcaucccuaccaacuucuccuucggagugacacaagaguacauccagaccacaauucagaaggugaccgucgacuguaaacaguauguuugcaauggcuuucaaaagugcgaacagcugcugagagaguacgggcaguucuguucuaagaucaaccaggcucuccacggagccaaucugcgccaagaugacagcgugcggaaccuuuuugcuuccgugaaaucuagccaguccagcccgauuauccccggcuucgggggcgacuuuaaucugacgcuccuggagccugucucuauuuccacaggaagcagaucugcccgcuccgcgaucgaagaucugcuuuucgacaaggugaccaucgccgaucccggcuacaugcagggguaugacgauugcaugcagcaaggaccugcuagcgcccgggaccucauuugugcucaguacguugccggcuauaaagugcugcccccucugauggaugucaacauggaggccgcuuacaccuccucucuccuggggagcaucgcgggagugggcuggacagccgggcuuuccagcuuugcugccauucccuucgcccagucuaucuuuuauagacugaauggcguuggaauuacccaacaggugcucuccgaaaaccagaagcugaucgcuaauaaauucaaccaggcccugggcgcgaugcaaacaggguuuacgaccacaaaugaggcuuuccggaagguccaggacgccgugaacaacaaugcccaggcucuuagcaagcucgccucugaacugagcaacaccuucggagcgaucuccgcuucuauuggcgauaucauucagcgccuggacguucucgagcaagaugcccagaucgacagacugauuaaugggcggcuuacaacccugaacgccuuuguggcucagcagcucgucagaagcgaguccgccgcucugucugcccaacuggcgaaagauaaggugaaugaaugcgugaaagcccagagcaagcgcuccggauucuguggccagggcacgcauaucgucagcuuuguugugaacgcuccgaaugggcuuuacuucaugcacgugggauauuacccuucuaaccauaucgaggucguguccgccuacggccugugcgacgcugccaaucccaccaacuguauugccccuguuaauggguauuuuaucaaaacaaacaauacccggauuguggacgaauggagcuacacaggauccucuuucuaugcucccgagccgaucaccagccucaacacaaaguacgucgcgccucaggugaccuaucaaaauauuuccacgaaccugcccccuccccuccugggcaacucuacagggaucgauuuucaggacgagcuugaugaguucuuuaagaauguuagcaccuccauucccaacuucggaagccugacccagaucaauacaacccuccuggaccugacguacgaaaugcuuucucugcaacagguggucaaagcccucaacgaauccuauaucgaucugaaggagcucggcaauuacacauacuauaacaaauggccuugguacauuuggcugggcuuuaucgcugggcuuguggcccuggcccucugcgucuucuuuauucuguguugcaccggauguggcacaaauugcauggggaagcugaaaugcaacagauguugcgaccgcuaugaagaguacgaucuugagccgcacaaggugcauguucacuga

SEQ ID NO: 983 - RNA, 4062 nt, Artificial Sequence
  derived and/or modified CDS sequence (opt5) from MERS-CoV__ANC28656__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugggcggaccgaagucccucagcucgugaacgccaaucaauauucccccuguguuagcauugugccgucuacagucugggaggacggagacuacuaccgcaaacagcuguccccucuggaaggcgggggauggcucguggcuagcggcuccaccguugccaugacagagcagcugcagaugggguuuggcaucaccgugcaauauggaacggauaccaacucugucugccccaaacuugaguucgcgaaugacacaaagauugcuagccagcugggcaacuguguggaauacucccucuauggggugucuggaagaggcguuuuucagaauugcaccgccgucggggugcggcagcaaagauucguguacgaugccuaucagaaccuggucggauacuauagcgacgauggcaacuacuacugucugcgcgcuugcguguccguuccugugucugucaucuaugacaaggagacaaagacccaugccacgcuuuuugggagcguggcuugugaacacauuuccagcacaaugucucaguacucccggagcaccagaucuaugcucaaacgccgggauuccacauauggcccccugcagaccccuguuggaugcgugcugggccucgucaauagcucucuguucguggaggacuguaaacuuccccuggggcaaucccucugcgcccugccggauaccccuagcacacugacgcccagauccguucgcagcgugcccggagaaaugcggcuugcgucuaucgccuuuaaccacccuauucaggucgaccagcucaauagcuccuacuucaagcugucuaucccgaccaacuuuagcuucggcgugacacaagaguauauccagaccacaauucagaaggugaccgucgauuguaaacaguacguuugcaauggguuccaaaagugcgaacagcugcucagagaguauggacaguuuuguuccaagaucaaccaggcucugcauggcgccaaucuucgccaagacgauucugugcggaaccuguucgcuagcgugaaauccucucagagcucccccauuaucccuggguuuggcggagacuucaaucucacgcugcuggagcccgucagcauuucuacaggcuccagaagcgcccgcucugcgaucgaagaccuucucuuugauaaggugaccaucgccgacccuggguacaugcagggauacgaugacugcaugcagcaaggccccgcuuccgcccgggaucugauuugugcucaguauguugccggguacaaagugcugccuccccucauggacgucaacauggaggccgcuuauaccagcucccugcuuggaucuaucgcgggcgugggguggacagccggccugagcuccuucgcugccauuccguuugcccagagcaucuucuacagacucaauggaguuggcauuacccaacaggugcugucugaaaaccagaagcugaucgcuaauaaauuuaaccaggcccuuggggcgaugcaaacaggauucacgaccacaaaugaggcuuuucggaagguccaggaugccgugaacaacaaugcccaggcucucuccaagcuggccagcgaacugucuaacaccuucggcgcgaucagcgcuuccauuggggacaucauucagcgccucgauguucuggagcaagacgcccagaucgauagacuuauuaauggacggcugacaacccucaacgccuucguggcucagcagcuggucagaucugagagcgccgcucuguccgcccaacuugcgaaagacaaggugaaugaaugcgugaaagcccagucuaagcgcagcggcuuuuguggccaggggacgcacaucgucuccuucguugugaacgcuccuaauggacuguauuuuaugcaugugggcuacuaucccagcaaccacaucgaggucgugucugccuacgggcucugcgaugcugccaauccuaccaacuguauugcccccguuaauggauacuucaucaaaacaaacaauacccggauuguggacgaaugguccuauacaggcagcuccuuuuacgcuccggagccuaucaccucucugaacacaaaguaugucgcgccccaggugaccuaccaaaauauuagcacgaaccucccuccuccccugcuugggaacuccacaggaaucgacuuccaggaugagcuggacgaauuuuucaagaauguuucuaccagcauucccaacuuuggcucccucacccagaucaauacaacccugcuggaucuuacguaugagaugcugagccuccaacagguggucaaagcccugaacgaaucuuacaucgaccucaaggagcugggcaauuauacauacuacaacaaauggccgugguauauuuggcuuggguucaucgcuggacugguggcccucgcccugugcgucuuuuucauucuguguugcaccggcugugggacaaauugcaugggaaaacuuaagugcaacagauguugcgaucgcuacgaagaguaugaccuggagccccauaaggugcacguucacuga

SEQ ID NO: 984 - RNA, 4062 nt, Artificial Sequence
  derived and/or modified CDS sequence (opt5) from MERS-CoV__ANC28678__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccaucugcagcauucagucugaucggaaggccugggcugccuucuauguuuacaaacugcagccgcucacauuucugcuggacuucuccguggauggguauauccgcagagcuaucgacuguggauuuaacgaucucagccaacugcauugcucuuacgagagcuucgacguggaauccggcgucuauucugugagcuccuuugaggccaagccuagcgggucuguuguggaacaggccgagggagucgagugugauuucagcccccuucuguccggcaccccuccccagguguacaacuuuaaacggcucguuuucacgaauugcaacuacaaucugacaaaacuucugucucucuucuccgugaacgacuuuaccuguagccaaauuucccccgcugcgaucgccucuaauugcuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaaguguucucgccuucugagcgaugggagaaccgaagucccucagcucgugaacgccaaucaauauucccccugcguuagcauugugccgucuacagucugggaggacggagacuacuaccggaaacagcuguccccucuggaaggcgggggauggcucguggcuagcggcuccaccguugccaugacagagcagcugcagaugggguuuggcaucaccgugcaauauggaacggauaccaacucugucugucccaaacuugaguucgcgaaugacacaaagauugcuagccagcugggcaacugcguggaauacucccucuauggggugucuggacgcggcguuuuucagaauuguaccgccgucggggugagacagcaacgguucguguacgaugccuaucagaaccuggucggauacuauagcgacgauggcaacuacuacugccugagagcuuguguguccguuccugugucugucaucuaugacaaggagacaaagacccaugccacgcuuuuugggagcguggcuugcgaacacauuuccagcacaaugucucaguacucccgcagcacccggucuaugcucaaaagacgcgauuccacauauggcccccugcagaccccuguuggaugugugcugggccucgucaauagcucucuguucguggaggacugcaaacuuccccuggggcaaucccucugugcccugccggauaccccuagcacacugacgccccgguccguuagaagcgugcccggagaaaugcgccuugcgucuaucgccuuuaaccacccuauucaggucgaccagcucaauagcuccuacuucaagcugucuaucccgaccaacuuuagcuucggcgugacacaagaguauauccagaccacaauucagaaggugaccgucgauugcaaacaguacguuugcaauggguuccaaaagugugaacagcugcuccgggaguauggacaguuuugcuccaagaucaaccaggcucugcauggcgccaaucuuagacaagacgauucugugcgcaaccuguucgcuagcgugaaauccucucagagcucccccauuaucccuggguuuggcggagacuucaaucucacgcugcuggagcccgucagcauuucuacaggcucccggagcgccagaucugcgaucgaagaccuucucuuugauaaggugaccaucgccgacccuggguacaugcagggauacgaugacuguaugcagcaaggccccgcuuccgcccgcgaucugauuugcgcucaguauguugccggguacaaagugcugccuccccucauggacgucaacauggaggccgcuuauaccagcucccugcuuggaucuaucgcgggcgugggguggacagccggccugagcuccuucgcugccauuccguuugcccagagcaucuucuaccggcucaauggaguuggcauuacccaacaggugcugucugaaaaccagaagcugaucgcuaauaaauuuaaccaggcccuuggggcgaugcaaacaggauucacgaccacaaaugaggcuuuuagaaagguccaggaugccgugaacaacaaugcccaggcucucuccaagcuggccagcgaacugucuaacaccuucggcgcgaucagcgcuuccauuggggacaucauucagcggcucgauguucuggagcaagacgcccagaucgaucgccuuauuaauggaagacugacaacccucaacgccuucguggcucagcagcugguccggucugagagcgccgcucuguccgcccaacuugcgaaagacaaggugaaugaaugugugaaagcccagucuaagagaagcggcuuuugcggccaggggacgcacaucgucuccuucguugugaacgcuccuaauggacuguauuuuaugcaugugggcuacuaucccagcaaccacaucgaggucgugucugccuacgggcucugugaugcugccaauccuaccaacugcauugcccccguuaauggauacuucaucaaaacaaacaauacccgcauuguggacgaaugguccuauacaggcagcuccuuuuacgcuccggagccuaucaccucucugaacacaaaguaugucgcgccccaggugaccuaccaaaauauuagcacgaaccucccuccuccccugcuugggaacuccacaggaaucgacuuccaggaugagcuggacgaauuuuucaagaauguuucuaccagcauucccaacuuuggcucccucacccagaucaauacaacccugcuggaucuuacguaugagaugcugagccuccaacagguggucaaagcccugaacgaaucuuacaucgaccucaaggagcugggcaauuauacauacuacaacaaauggccgugguauauuuggcuuggguucaucgcuggacugguggcccucgcccugugugucuuuuucauucugugcuguaccggcugcgggacaaauugcaugggaaaacuuaaguguaaccggugcugugauagauacgaagaguaugaccuggagccccauaaggugcacguucacuga

SEQ ID NO: 985 - RNA, 4059 nt, Artificial Sequence
  derived and/or modified CDS sequence (opt5) from MERS-CoV__AHL18090__S
augauccacagcguguuccugcucauguuucugcuuacccccacagaguccuacgucgacguuggccuggauucugccaagagcgcuugcauugaaguggacauccagcaaacguucuuugauaaaaccuggccuagaccgauugacguguccaaggccgaugggaucauuuauccccagggacggacauacucuaacaucaccaucacauaucagggccucuucccuuaccagggggaccauggagauauguaugucuacagcgcgggccacgcuaccgggacaacgccccaaaaacuguuuguggccaauuauucccaggacguuaagcaguucgccaacggauuugugguccgcauuggcgcugccgcuaauucuaccggcaccgugaucauuagcccuuccacaagcgccaccaucagaaaaauuuaccccgcguucaugcuugggucuuccguuggaaacuuuagcgauggcaagauggggcgguucuuuaaucauacacuggugcuccugccugacggauguggcacccugcuccgcgccuucuacugcauccuggagccgagaucugggaacuauugucccgcuggaaauuccuacacgagcuuugccacauaucacaccccugcuacagauugcucugacggcaacuacaaucggaacgccucccuuaauagcuucaaggaauauuucaaccugcgcaauuguaccuuuauguacaccuauaacauuacagaggaugaaauccucgagugguucggcaucacgcagaccgcgcaagggguccaucuguuuuccucuagauacguggaccuuuacggaggcaauauguuccaguuugccacacugcccguguaugacaccauuaaauacuauagcaucauuccucacuccauccggagcauucagucugaucgcaaggcuugggccgcuuucuacgucuauaaacuccagccccugacauuucugcucgacuucuccguugauggguacaucagacgggccaucgacugcggauuuaacgaucugagccaacuucacuguucuuaugagagcuucgacguggaauccggcguguacucugucagcuccuuugaggccaagccgagcgggucugugguugaacaggcugagggaguggagugcgauuucuccccucugcucagcggcacgcccccucaggucuacaacuuuaaacgccugguguucaccaauuguaacuauaaucuuacaaagcugcucucucuguucuccguuaacgacuuuaccugcagccaaauuucccccgcggccaucucuagcaauuguuacuccucucugauucucgauuauuucagcuacccccuguccaugaaaagcgaccuuucuguguccagcgcuggcccuaucucucaguuuaacuauaagcaguccuucagcaauccgaccugccugauucucgccacagucccccauaaccugaccacaaucacgaagccucuuaaauacucuuauaucaauaagugcagcagacugcucuccgaugaccggaccgaagugccccagcuggucaacgccaaucaauacagcccuugugugucuauuguucccuccacagugugggaggacggggauuacuaucgcaaacagcugagcccgcucgaaggaggcggguggcuggucgcuuccggaucuaccguggccaugacagagcagcuucagaugggcuuugggaucaccguucaauacggcacggacaccaacagcgugugcccuaagcuggaguucgcgaaugauacaaaaauugcuucccagcucggaaacugugucgaauauucucuguacggcgugagcgggagaggaguguuucagaauugcaccgccguuggcguccggcagcaaagauucguguaugacgccuaccagaaccuggugggguauuacuccgaugacggaaacuacuauugucuucgcgcuugcgucucugugcccguuagcgugaucuacgauaagaagacaaaaacccacgccacgcucuuuggcuccgucgcuugugagcauauuagcucuacaaugucccaguauagccggucuaccagauccacacugaagcgccgggacagcaccuacgggccucugcagacccccgugggcugcguucucggacuggucaauucuucccuuuucguggaagauuguaaacugccucucggccaaagccugugcgcccugcccgacacaccguccacgcuuaccccuagaagcgugcgcucuguucccgggcagaugcggcucgcgagcaucgccuuuaaccaccccauucagguggaucaacucaauuccucuuauuucaagcugagcaucccuacaaacuuuuccuucggagucacccaggaguacauccagacaaccauucagaaagugacgguggacuguaagcaauaugucugcaauggcuuccagaagugcgaacagcuccugagagaguacgggcaguuuuguucuaaaaucaaccaagcccuucacggagcuaaucugcgccaggaugacagcguucggaaccucuucgcuuccgugaagucuagccaguccagcccgauuauccccggcuuugggggcgacuucaaucugacacugcuugaaccugugucuauuuccaccggaagcagaucuucccgcaucgccaucgaggaucuccuguuugacaaagucaccauugcggaucccggcuacaugcagggguaugacgauugcaugcaacagggaccuagcuccgcccgggaccugaucugugcucaguacguggccggcuauaagguucugcccccucugauggaugugaacauggaggcugccuacacaucuagccuucugggguccauugccggagucggcuggaccgcugggcucagcucuuucgcggccauccccuuugcucaauccauuuucuauagacugaauggcgugggaaucacacagcagguucugagcgaaaaccagaaacuuaucgccaauaaguuuaaccaagcccucggcgcuaugcagacgggguucaccacaaccaaugaggccuuucagaaggugcaggacgcggucaacaacaaugcucaagcccugucuaaacuggccagcgaacucuccaacacauucggagcuauuucugccagcaucggcgauauuauccagcggcuggacgugcuugagcaggaugcgcagauugaccgccugaucaaugggagacucaccacgcugaacgcuuucguugcccaacagcuggugcgguccgaaucugccgcucuuagcgcccagcuggcuaaggauaaagucaaugagugcgugaaggcccaguccaaaagaagcggauuuuguggccaaggcacccauaucgugucuuucgucguuaacgcgccgaaugggcucuacuuuaugcacgugggauauuacccuuccaaccauauugagguggucagcgccuacggccugugcgacuccgcuaaucccacaaacuguaucgccccugugaauggguauuucauuaagaccaacaauacacgcaucguugacgaauggucuuacaccggaagcuccuuuuaugcucccgagccgauuacaucucucaacaccaaguacguggccccucaggucacguaucagaauaucagcacaaaccugcccccuccccuucugggcaacuccaccgggauugauuuccaagacgaacucgaugaguuuuucaaaaaugugagcaccucuauccccaacuuuggaucccugacacagaucaauaccacgcugcuugaccugacauacgagaugcucagccugcagcagguugugaaggcccucaacgaaucuuauauugaucugaaagagcuuggcaauuacaccuacuauaaguggccuugguacaucuggcugggcuucauugcugggcucgucgcgcuggcccugugcguguuuuucauccuuuguugcacaggauguggcaccaacugcauggggaaacugaagcggaauagaugcugugaccgcuaugaagaguacgaucucgaaccgcacaaaguccaugugcacuga

SEQ ID NO: 986 - RNA, 4062 nt, Artificial Sequence
  derived and/or modified CDS sequence (opt5) from MERS-CoV__AHX00731__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugggcgucagcucugcugggccgaucucccaguuuaacuacaagcagagcuucucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggagauuacuaccgcaaacagcugucuccucuggaaggcgggggauggcucguggcuuccggcagcaccguugccaugacagagcagcugcagaugggguuuggcaucaccgugcaauauggaacggacaccaacuccgucugccccaaacuugaauuugcgaaugauacaaagauugcuucucagcugggcaacuguguggaguacagccucuaugggguguccggaagaggcguuuuucagaauugcaccgccgucggggugcggcagcaaagauucguguacgacgccuaucagaaccuggucggauacuauucugaugacggcaacuacuacugucugcgcgcuugcgugagcguuccuguguccgucaucuaugauaaggagacaaagacccaugccacgcuuuuugggucuguggcuugugaacacauuagcuccacaaugagccaguacucucgguccaccagaagcaugcucaaacgccgggacucuacauauggcccccugcagaccccuguuggaugcgugcugggccucgucaauuccagccuguucguggaggauuguaaacuuccccuggggcaaucucucugcgcccugccggacaccccuuccacacugacgcccagaagcguucgcuccgugcccggagaaaugcggcuugcgagcaucgccuuuaaccacccuauucaggucgaucaguucaauucuagcuacuuuaagcucuccaucccgaccaacuucucuuucggcgugacacaagaguauauccagaccacaauucagaaggugaccgucgacuguaaacaguacaucugcaauggguuucaaaagugcgaacagcugcugagagaguauggacaguucuguagcaagauuaaccaggcucuccauggcgccaaucugcgccaagaugacuccguucggaaccuuuuugcuucugugaaaagcucccagucuagccccaucauuccuggguucggcggagacuuuaaucugacgcuccuggagcccguguccaucagcacaggcucuagauccgcccgcagcgcgaucgaagaucugcuuuucgacaaggucaccauugccgauccuggguacaugcagggauacgacgauugcaugcagcaaggccccgcuucugcccgggaccucaucugugcucaguauguggccggguacaaaguucugccuccccugauggaugugaacauggaggccgcuuauaccuccagccuccugggauccauugcgggcgucggguggacagccggccuuucuagcuuugcugccaucccguucgcccaguccauuuucuacagacugaauggagugggcaucacccaacagguucucagcgaaaaccagaagcugaucgcuaauaaauucaaccaggcccugggggcgaugcaaacaggauuuacgaccacaaaugaggcuuuccggaaggugcaggacgccgucaacaacaaugcccaggcucuuucuaagcucgccuccgaacugagcaacaccuucggcgcgauuucugcuagcaucggggauauuauccagcgccuggacgugcucgagcaagaugcccagauugacagacugaucaauggacggcuuacaacccugaacgccuuuguugcucagcagcucgugagauccgagucugccgcucugagcgcccaacuggcgaaagauaaggucaaugaaugcgugaaagcccaguccaagcgcucuggcuucuguggccaggggacgcacaucgugagcuuugucguuaacgcuccuaauggacuuuauuucaugcaugugggcuacuaucccuccaaccacauugagguggucagcgccuacgggcugugcgacgcugccaauccuaccaacuguaucgcccccgugaauggauacuuuauuaaaacaaacaauacccggaucguugacgaauggucuuauacaggcuccagcuucuacuccccggagccuauuaccucucucaacacaaaguauguggcuccccaggucaccuaccaaaauaucagcacgaaccugccuccuccccuccuggggaacuccacaggaauugauuuucaggacgagcuugaugaguucuuuaagaaugugucuaccagcauccccaacuucggcucccugacccagaucaauacaacccuccuggaccugacguaugaaaugcuuagccugcaacagguugugaaagcgcucaacgaaucuuacauugaucugaaggagcucggcaauuauacauacuacaacaaauggccgugguauaucuggcugggguuuauugccggacuugucgcucuggcccucugcguguucuuuauccuguguugcaccggcugugggacaaauugcaugggaaagcugaaaugcaacagauguugcgaccgcuacgaagaguaugaucuugagccccauaagguccacgugcacuga

SEQ ID NO: 987 - RNA, 4062 nt, Artificial Sequence
  derived and/or modified CDS sequence (opt5) from MERS-CoV__AHX71946__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauucccauacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaccucuuuuccucuagauacguggaccuguauggaggcaauauguuccaguuugcgacacuuccugucuacgacaccauuaaauacuauagcaucauuccccauuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguauaacuuuaaacgccucguuuucacgaauuguaacuacaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuauuaccgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuauuacugucugcgcgcuugcguguccguuccugugucugucaucuacgauaaggagacaaagacccacgccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccauccuauucaggucgaucagcucaauagcuccuauuucaagcugucuaucccgaccaacuuuagcuucggagugacacaagaguacauccagaccacaauucagaaggugaccgucgacuguaaacaguauguuugcaauggcuuccaaaagugcgaacagcugcucagagaguacgggcaguuuuguuccaagaucaaccaggcucugcacggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuauaugcagggguacgacgauugcaugcagcaaggacccgcuuccgcccgggaccugauuugugcucaguacguugccggcuauaaagugcugccuccccucauggaugucaacauggaggccgcuuacaccagcucccugcuugggucuaucgcgggagugggcuggacagccgggcugagcuccuucgcugccauuccguuugcccagagcaucuucuauagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcauaucgucuccuucguugugaacgcuccuaaugggcuguacuuuaugcacgugggauauuaccccagcaaccauaucgaggucgugucugccuauggccucugcgacgcugccaauccuaccaacuguauugcccccguuaauggguacuucaucaaaacaaacaauacccggauuguggacgaaugguccuacacaggaagcuccuuuuaugcuccggagccuaucaccucucugaacacaaaguacgucgcgccccaggugaccuaucaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguacgagaugcugagccuccaacagguggucaaagcccugaacgaaucuuauaucgaucucaaggagcugggcaauuacacauauuacaacaaauggccgugguacauuuggcuuggcuucaucgcugggcugguggcccucgcccugugcgucuuuuucauucuguguugcaccggauguggcacaaauugcauggggaaacuuaagugcaacagauguugcgaccgcuaugaagaguacgaucuggagccccacaaggugcacguucauuga

SEQ ID NO: 988 - RNA, 4062 nt, Artificial Sequence
  derived and/or modified CDS sequence (opt5) from MERS-CoV__AHY22545__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaucgccucguuuucacgaacuguaauuacaaccugacaaaacuucugucucucuucuccgugaaugacuuuaccugcagccaaauuucccccgcugcgaucgccucuaacuguuauagcucccugauucuggauuacuucucuuauccucucagcaugaaguccgaccugagcgucucuuccgcuggcccgaucagccaguuuaauuacaagcagucuuucuccaacccuaccugccuuauucuggccacagugccccacaaucucaccacaaucacgaaaccccugaaguauagcuacaucaacaaaugcucuagacuucugagcgaugaccggaccgaagucccucagcucgugaaugccaaccaauauucccccuguguuagcauugugccgucuacagucugggaggacggggauuacuaccgcaagcagcuguccccucuggaaggaggcggguggcucguggcuagcggauccaccguugccaugacagagcagcugcagaugggcuuugggaucaccgugcaauauggcacggacaccaauucugucugccccaaacuugaguucgcgaacgauacaaagauugcuagccagcugggaaauuguguggaauacucccucuauggcgugucugggagaggaguuuuucagaacugcaccgccgucggcgugcggcagcaaagauucguguacgacgccuaucagaaccuggucggguacuauagcgaugacggaaauuacuacugucugcgcgcuugcguguccguuccugugucugucaucuaugauaaagagacaaagacccaugccacgcuuuuuggcagcguggcuugugaacacauuuccagcacaaugucucaguacucccggagcaccagaucuaugcucaagcgccgggacuccacauaugggccccugcagaccccuguuggcugcgugcugggacucgucaacagcucucuguucguggaggauuguaaacuuccccugggccaaucccucugcgcccugccggacaccccuagcacacugacgcccagauccguucgcagcgugcccggggaaaugcggcuugcgucuaucgccuuuaaucacccuauucaggucgaucagcucaacagcuccuacuucaagcugucuaucccgaccaauuuuagcuucggagugacacaagaguauauccagaccacaauucagaaagugaccgucgacuguaagcaguacguuugcaacggcuuccaaaaaugcgaacagcugcucagagaguaugggcaguuuuguuccaagaucaaucaggcucugcauggagccaaccuucgccaagaugacucugugcggaaucuguucgcuagcgugaaguccucucagagcucccccauuaucccuggcuuugggggcgacuucaaccucacgcugcuggagcccgucagcauuucuacaggauccagaagcgcccgcucugcgaucgaagaucuucucuuugacaaagugaccaucgccgauccuggcuacaugcagggguacgacgauugcaugcagcaaggacccgcuuccgcccgggaccugauuugugcucaguauguugccggcuacaaggugcugccuccccucauggaugucaauauggaggccgcuuauaccagcucccugcuugggucuaucgcgggagugggcuggacagccgggcugagcuccuucgcugccauuccguuugcccagagcaucuucuacagacucaacggcguuggaauuacccaacaggugcugucugaaaaucagaaacugaucgcuaacaaguuuaaucaggcccuuggcgcgaugcaaacaggguucacgaccacaaacgaggcuuuucggaaaguccaggacgccgugaacaauaacgcccaggcucucuccaagcuggccagcgaacugucuaauaccuucggagcgaucagcgcuuccauuggcgauaucauucagcgccucgacguucuggagcaagaugcccagaucgacagacuuauuaacgggcggcugacaacccucaaugccuucguggcucagcagcuggucagaucugagagcgccgcucuguccgcccaacuugcgaaggauaaagugaacgaaugcgugaaggcccagucuaaacgcagcggauuuuguggccagggcacgcacaucgucuccuucguugugaaugcuccuaacgggcuguauuuuaugcaugugggauacuaucccagcaaucacaucgaggucgugucugccuacggccucugcgacgcugccaacccuaccaauuguauugcccccguuaacggguacuucaucaagacaaauaacacccggauuguggacgaaugguccuauacaggaagcuccuuuuacgcuccggagccuaucaccucucugaauacaaaauaugucgcgccccaggugaccuaccaaaacauuagcacgaaccucccuccuccccugcuuggcaauuccacagggaucgauuuccaggacgagcuggaugaauuuuucaagaacguuucuaccagcauucccaauuuuggaucccucacccagaucaacacaacccugcuggaccuuacguaugagaugcugagccuccaacagguggucaaggcccugaaugaaucuuacaucgaucucaaagagcugggcaacuauacauacuacaauaaguggccgugguauauuuggcuuggcuucaucgcugggcugguggcccucgcccugugcgucuuuuucauucuguguugcaccggauguggcacaaacugcauggggaaacuuaagugcaauagauguugcgaccgcuacgaagaguaugaucuggagccccauaaagugcacguucacuga

SEQ ID NO: 989 - RNA, 4062 nt, Artificial Sequence
  derived and/or modified CDS sequence (opt5) from MERS-CoV__AHY22555__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaauuacacacuuguccugcucccggacggauguggcacccugcugcgcgcguucuauugcauccucgagcccagaucugggaaccauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcuuccuucuacguuuauaaacugcagccgcucacauuucugcuggacuucagcguggauggguacaucagacgggccaucgacugcggauuuaacgaucucucucaacugcacuguagcuaugaguccuucgacguggaaucuggcgucuacagcguguccagcuuugaggcuaagccuucuggguccguuguggaacaggccgagggagucgagugcgauuucagcccccuucugucuggcaccccuccccagguguacaacuuuaaacgccucguuuucacgaauuguaacuauaaucugacaaaacuucugucccucuucagcgugaacgacuuuaccugcucccaaauuucucccgccgcuaucgcgagcaauuguuacuccucucugauucuggauuauuucagcuacccucucuccaugaaaagcgaccugucugucuccagcgccggcccgaucucucaguuuaacuauaagcaguccuucagcaauccuaccugccuuauucuggcuacagugccccauaaccucaccacaaucacgaagccccugaaguacucuuauaucaauaagugcagcagacuucuguccgaugaccggaccgaagucccucagcucgugaacagcaaucaauacucucccuguguuuccauugugccgagcacagucugggaggacggggauuacuaucgcaaacagcuguccccucuggaaggaggcggguggcucguggccucuggaagcaccguugccaugacagagcagcugcagaugggcuuugggaucaccgugcaauacggcacggacaccaacuccgucugccccaaacuugaguucgcuaaugauacaaagauugccucucagcugggaaacuguguggaauauagccucuacggcguguccgggagaggaguuuuucagaauugcaccgcggucggcgugcggcagcaaagauucguguaugacgcuuaccagaaccuggucggguauuacucugaugacggaaacuacuauugucugcgcgccugcgugagcguuccuguguccgucaucuacgauaaggagacaaagacccacgccacgcuuuuuggcagcguggcuugugaacauauuucuuccacaaugagccaguauucucgguccaccagaagcaugcucaaacgccgggacucuacauacgggccccugcagaccccuguuggcugcgugcugggacucgucaauuccagccuguucguggaggauuguaaacuuccccugggccaaucccucugcgcccugccggacaccccuagcacacugacgcccagaucuguucgcagcgugcccggggaaaugcggcuugcuuccaucgccuuuaaccacccuauucaggucgaucagcucaauucuagcuauuucaagcuguccaucccgaccaacuuuucuuucggagugacacaagaguacauccagaccacaauucagaaggugaccgucgacuguaaacaguauguuugcaauggcuuccaaaagugcgaacagcugcucagagaguacgggcaguuuuguagcaagaucaaccaggcgcugcacggagccaaucuucgccaagaugacuccgugcggaaccuguucgcuucugugaaaagcucccagagcucucccauuaucccuggcuuugggggcgacuucaaucucacgcugcuggagcccgucuccauuagcacaggaucuagauccgcccgcagcgcuaucgaagaucuucucuuugacaaggugaccaucgccgauccuggcuacaugcagggguaugacgauugcaugcagcaaggacccgcguccgcccgggaccugauuugugcucaguacguugccggcuauaaagugcugccuccccucauggaugucaacauggaggcugccuacaccucuagccugcuuggguccaucgccggagugggcuggacagcugggcugagcucuuucgcggccauuccguuugcucaguccaucuucuauagacucaauggcguuggaauuacccaacaggugcugagcgaaaaccagaagcugaucgccaauaaauuuaaccaggcccuuggcgcuaugcaaacaggguucacgaccacaaaugaggccuuucauaagguccaggacgcggugaacaacaaugcucaggcccucucuaagcuggccagcgaacuguccaacaccuucggagcuaucucugccagcauuggcgauaucauucagcggcucgacguucuggagcaagaugcgcagaucgaccgccuuauuaaugggagacugacaacccucaacgcuuucguggcccagcagcugguccgguccgagucugccgcucugagcgcccaacuugcuaaagauaaggugaaugaaugcgugaaagcccaguccaagagaagcggauuuuguggccagggcacgcacaucgucucuuucguugugaacgcgccuaaugggcuguacuuuaugcaugugggauauuaccccuccaaccacaucgaggucgugagcgccuacggccucugcgacgcugccaauccuaccaacuguauugcucccguuaauggguauuucaucaaaacaaacaauacccgcauuguggacgaaugguccuacacaggaucuagcuuuuaugccccggagccuaucaccucccugaacacaaaguacgucgcuccccaggugaccuaucaaaauauuucuacgaaccucccuccuccccugcuuggcaacagcacagggaucgauuuccaggacgagcuggaugaauuuuucaagaauguuuccaccagcauucccaacuuuggaucucucacccagaucaauacaacccugcuggaccuuacguacgagaugcugucccuccaacagguggucaaagcccugaacgaaagcuauaucgaucucaaggagcugggcaauuacacauacuauaacaaauggccgugguacauuuggcuuggcuucaucgcggggcugguggcccucgcucugugcgucuuuuucauucuguguugcaccggauguggcacaaauugcauggggaaacuuaagugcaaccgguguugcgacagauaugaagaguacgaucuggagccccauaaggugcacguucacuga

SEQ ID NO: 990 - RNA, 4062 nt, Artificial Sequence
  derived and/or modified CDS sequence (opt5) from MERS-CoV__AHY22565__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaucauuagaaaaaucuacccugccuucaugcuggggucuuccgugggaaacuuuagcgauggcaagauggggcgguucuuuaaucauacccuuguccugcucccggacggauguggcacacugcugcgcgcguucuacugcauucucgagcccagaucugggaaccacuguccugccggaaauuccuauaccagcuuugcuacguaccauacacccgccaccgauugcucugacggcaacuauaaucggaacgcuucccugaauagcuucaaggaauacuucaaccuucgcaauuguacauuuauguauaccuacaacaucaccgaggaugaaauccuggagugguucggcauuacacagacggcccaaggggugcaccucuuuuccucuagauauguggaccuguacggaggcaauauguuccaguuugcgacccuuccugucuacgacacaaucaaauauuacagcauuaucccccacuccauucggagcauccagucugaucgcaaggccugggcuuccuucuauguuuacaaacugcagccgcucaccuuucugcuggacuucagcguggauggguauaucagacgggccauugacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcacaccuccccagguguacaacuuuaaacgccucguuuucaccaauuguaacuacaaucugacgaaacuucugucccucuucagcgugaacgacuuuacaugcucccaaaucucucccgccgcuauugcgagcaauuguuauuccucucugauccuggauuacuucagcuauccucucuccaugaaaagcgaccugucugucuccagcgccggcccgauuucucaguuuaacuacaagcaguccuucagcaauccuaccugccuuauccuggcuaccgugccccacaaccucacaaccaucacaaagccccugaaguauucuuacauuaauaagugcagcagacuucuguccgaugaccggacggaagucccucagcucgugaacgccaaucaauauagccccuguguuucuaucgugccguccaccgucugggaggacggggauuacuaccgcaaacagcugagcccucuggaaggaggcggguggcucguggccuccggaucuacaguugcuaugaccgagcagcugcagaugggcuuugggauuacagugcaauauggcaccgacacgaacagcgucugccccaaacuugaguucgccaaugauaccaagaucgcgucccagcugggaaacuguguggaauacucucucuauggcgugagcgggagaggaguuuuucagaauugcacagcugucggcgugcggcagcaaagauucguguacgacgccuaucagaaccuggucggguacuauuccgaugacggaaacuacuacugucugcgcgccugcgugucuguuccugugagcgucauuuaugauaaggagaccaagacacaugcuacccuuuuuggcuccguggccugugaacacaucagcucuacgaugucccaguacagccggucuacaagauccaugcucaaacgccgggacagcaccuaugggccccugcagacaccuguuggcugcgugcugggacucgucaauucuucccuguucguggaggauuguaaacuuccccugggccaaagccucugcgcucugccggacaccccuuccacccugacacccagaagcguucgcucugugcccggggaaaugcggcuugccagcauugcguuuaaccacccuauccaggucgaucagcucaauuccucuuacuucaagcugagcaucccgacgaacuuuuccuucggagugacccaagaguauauucagacaaccauccagaaggugacagucgacuguaaacaguacguuugcaauggcuuccaaaagugcgaacagcugcucagagaguaugggcaguuuuguucuaagauuaaccaggcccugcauggagcuaaucuucgccaagaugacagcgugcggaaccuguucgccuccgugaaaucuagccaguccagccccaucauuccuggcuuugggggcgacuucaaucucacccugcuggagcccgucucuaucuccacgggaagcagaucugcucgcuccgccaucgaagaucuucucuuugacaaggugacaauugcggauccuggcuacaugcagggguacgacgauugcaugcagcaaggacccgccagcgcucgggaccugaucugugcccaguauguugcuggcuacaaagugcugccuccccucauggaugucaacauggaggccgccuauaccuccucucugcuugggagcauugcuggagugggcuggaccgcggggcuguccagcuucgccgcuaucccguuugcccagucuauuuucuacagacucaauggcguuggaaucacacaacaggugcuguccgaaaaccagaagcugaucgccaauaaauuuaaccaggcucuuggcgccaugcaaaccggguucacaacgaccaaugaggcguuucggaagguccaggacgcugugaacaacaaugcccaggcccucagcaagcuggcuucugaacugagcaacacauucggagccauuuccgcgucuaucggcgauauuauccagcgccucgacguucuggagcaagaugcucagauugacagacuuaucaaugggcggcugaccacacucaacgccuucguggcccagcagcuggucagaagcgaguccgcugcccugucugcucaacuugccaaagauaaggugaaugaaugcgugaaagcgcagagcaagcgcuccggauuuuguggccagggcacccacaucgucagcuucguugugaacgccccuaaugggcuguauuuuaugcaugugggauacuaucccucuaaccacauugaggucguguccgcuuacggccucugcgacgccagcaauccuacgaacuguaucgcucccguuaauggguacuucauuaaaaccaacaauacacggaucguggacgaaugguccuauaccggaucuagcuuuuacuccccggagccuauuacaucucugaacaccaaguaugucgcuccccaggugacauaccaaaauaucagcaccaaccucccuccuccccugcuuggcaacuccacggggauugauuuccaggacgagcuggaugaauuuuucaagaauguuagcacaucuauccccaacuuuggaucccucacccagaucaauaccacacugcuggaccuuaccuaugagaugcugagccuccaacagguggucaaagcccugaacgaaucuuacauugaucucaaggagcugggcaauuauacguacuacaacaaauggccgugguauaucuggcuuggcuucauugccgggcugguggcgcucgcccugugcgucuuuuucauccuguguugcacaggauguggcaccaauugcauggggaaacuuaagugcaacagauguugcgaccgcuacgaagaguaugaucuggagccccauaaggugcacguucacuga

SEQ ID NO: 991 - RNA, 4062 nt, Artificial Sequence
  derived and/or modified CDS sequence (opt5) from MERS-CoV__AJG44069__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucgcaaacucuuuguugcuaauuauucccaagacgugaagcaguucgccaacggauuugucgugagaauuggcgccgcugccaauucuacgggcaccguuaucauuagccccuccacaagcgcuaccauccggaaaauuuacccugccuucaugcuggggucuuccgugggaaacuuuagcgauggcaagauggggcgcuucuuuaaucauacacuuguccugcucccggacggauguggcacccugcugagagcguucuacugcauccucgagccccggucugggaaccacuguccugccggaaauuccuauacgagcuuugcuacauaccauacccccgccacagauugcucugacggcaacuauaaucgcaacgcuucccugaauagcuucaaggaauacuucaaccuuagaaauuguaccuuuauguauaccuacaacauuacagaggaugaaauccuggagugguucggcaucacgcagaccgcccagggggugcaccucuuuuccucucgguauguggaccuguacggaggcaauauguuccaauuugcgacacuuccugucuacgacaccauuaaauauuacagcaucauuccccacuccauccgcagcauucagucugauagaaaggccugggcugccuucuauguuuacaaacugcagccgcucacauuucugcuggacuucuccguggauggguauauccggcgcgcuaucgacugcggauuuaacgaucucagccagcugcauuguucuuacgagagcuucgacguggaauccggcgucuauucugugagcuccuuugaggccaagccuagcgggucuguuguggaacaagccgagggagucgagugcgauuucagcccccuucuguccggcaccccuccccagguguacaacuuuaaaagacucguuuucacgaauuguaacuacaaucugacaaagcuccugucucucuucuccgugaacgacuuuaccugcagccagauuucccccgcugcgaucgccucuaauuguuauagcucccugauucuggauuacuucucuuauccucucagcaugaaguccgaccugagcgucucuuccgcuggcccgaucagccaauuuaacuacaaacagucuuucuccaauccuaccugccuuauucuggccacagugccccacaaccucaccacaaucacgaagccccugaaauauagcuacaucaauaagugcucucggcuucugagcgaugaccgcaccgaagucccucagcucgugaacgccaaucaguauucccccuguguuagcauugugccgucuacagucugggaggacggggauuacuacagaaaacaacuguccccucuggaaggaggcggguggcucguggcuagcggauccaccguugccaugacagagcagcugcagaugggcuuugggaucaccgugcaguauggcacggacaccaacucugucugccccaaacuugaguucgcgaaugauacaaagauugcuagccaacugggaaacuguguggaauacucccucuauggcgugucugggcggggaguuuuucagaauugcaccgccgucggcgugagacagcagcgcuucguguacgacgccuaucaaaaccuggucggguacuauagcgaugacggaaacuacuacugucugcgggcuugcguguccguuccugugucugucaucuaugauaaggagacaaagacccaugccacgcuuuuuggcagcguggcuugugaacacauuuccagcacaaugucucaguacuccagaagcacccgcucuaugcucaaacggagagacuccacauaugggccccugcagaccccuguuggcugcgugcugggacucgucaauagcucucuguucguggaggauuguaaacuuccccugggccagucccucugcgcccugccggacaccccuagcccccugacaccccgcuccguucggagcgugccuggggaaaugagacuugcgucuaucgccuuuaaccacccgauucaagucgaucagcucaauagcuccuacuucaagcugucuauccccacgaacuuuagcuucggagugacccaggaguauauccaaacaaccauucagaaggugacagucgacuguaaacaguacaucugcaauggcuuccagaagugcgaacaacugcuccgcgaguaugggcaguuuuguuccaagauuaaccaggcucugcauggagccaaucuucggcaggaugacucuguuagaaaccuguucgcuagcgugaaauccucucaaagcuccccuaucauucccggcuuugggggcgacuucaaucucacccugcuggagccugugagcaucucuacgggaucccgcagcgcccggucugcgaucgaagaucuucucuuugacaaggucacaauugccgaucccggcuacaugcagggguacgacgauugcaugcagcagggaccugcuuccgccagagaccugaucugugcucaauauguggccggcuacaaaguucugcccccgcucauggaugugaacauggaggccgcuuauaccagcucccugcuugggucuauugcgggagucggcuggaccgccgggcugagcuccuucgcugccaucccuuuugcccagagcauuuucuaccggcucaauggcgugggaaucacacagcaaguucugucugaaaaccagaagcugaucgcuaauaaauuuaaccaggcccuuggcgcgaugcagaccggguucacaacgaccaaugaggcuuuucgcaaggugcaagacgccgucaacaacaaugcccaggcucucuccaagcuggccagcgaacugucuaacacauucggagcgauuagcgcuuccaucggcgauauuauccagagacucgacgugcuggagcaggaugcccaaauugaccggcuuaucaaugggagacugaccacacucaacgccuucguugcucagcagcuggugcgcucugagagcgccgcucuguccgcccagcuugcgaaagauaaggucaaugaaugcgugaaagcccaaucuaagcggagcggauuuuguggccagggcacccacaucguguccuucgucguuaacgcucccaaugggcuguauuuuaugcaugugggauacuauccuagcaaccacauugagguggucucugccuacggccucugcgacgcugccaaucccacgaacuguaucgccccggugaauggguacuucauuaaaaccaacaauacaagaaucguugacgaaugguccuauaccggaagcuccuuuuacucuccugagcccauuacaagccugaacaccaaguauguggcuccucaggucacauaccagaauaucuccaccaaccuucccccuccccugcuuggcaacucuacggggauugauuuccaagacgagcuggaugaauuuuucaagaaugugagcacauccaucccgaacuuuggaagccucacccagaucaauaccacacugcuggaccuuaccuaugagaugcugucucuccagcaaguugugaaagcgcugaacgaauccuacauugaucucaaggagcugggcaauuauacguacuacaacaaauggcccugguauaucuggcuuggcuucauugccgggcuggucgcucucgcccugugcguguuuuucauccuguguugcacaggauguggcaccaauugcauggggaaacuuaagugcaaccgcuguugcgacagauacgaagaguaugaucuggagccucauaagguccacgugcacuga

SEQ ID NO: 992 - RNA, 4062 nt, Artificial Sequence
  derived and/or modified CDS sequence (opt5) from MERS-CoV__AJG44080__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauuaagucugaucgcaaagccugggcugccuucuauguuuacaagcugcagccgcucacauuucugcuggacuucuccguggauggguauaucagacgggcuaucgacugcggauuuaacgaucucagccagcugcauuguucuuacgagagcuucgacguggaauccggcgucuauucugugagcuccuuugaggccaaaccuagcgggucuguuguggaacaagccgagggagucgagugcgauuucagcccccuucugagcggcaccccuccccagguguacaacuuuaagcgccucguuuucacgaauuguaacuacaaucugacaaagcuccugucucucuucuccgugaacgacuuuaccugcagccagauuucccccgcugcgaucgccucuaauuguuauagcucccugauucuggauuacuucucuuauccucucagcaugaaauccgaccugagcgucucuuccgcuggcccgaucagccaauuuaacuacaagcagucuuucuccaauccuaccugccuuauucuggccacagugccccacaaccucaccacaaucacgaaaccccugaaguauagcuacaucaauaaaugcucuagacuucugagcgaugaccggaccgaagucccucagcucgugaacgccaaucaguauucccccuguguuagcauugugccgucuacagucugggaggacggggauuacuaccgcaagcaacuguccccucuggaaggaggcggguggcucguggcuagcggauccaccguugccaugacagagcagcugcagaugggcuuugggaucaccgugcaguauggcacggacaccaacucugucugccccaaacuugaguucgcgaaugauacaaagauugcuagccaacugggaaacuguguggaauacucccucuauggcgugucugggagaggaguuuuucagaauugcaccgccgucggcgugcggcagcagagauucguguacgacgccuaucaaaaccuggucggguacuauagcgaugacggaaacuacuacugucugcgcgcuugcguguccguuccugugucugucaucuaugauaaggagacaaaaacccaugccacgcuuuuuggcagcguggcuugugaacacauuuccagcacaaugucucaguacucccggagcaccagaucuaugcucaagcgccgggacuccacauaugggccccugcagaccccuguuggcugcgugcugggacucgucaauagcucucuguucguggaggauuguaaacuuccccugggccagucccucugcgcccugccggacaccccuagcccccugacacccagauccguucgcagcgugccuggggaaaugcggcuugcgucuaucgccuuuaaccacccgauucaagucgaucagcucaauagcuccuacuucaagcugucuauccccacgaacuuuagcuucggagugacccaggaguauauccaaacaaccauucagaaagugacagucgacuguaagcaguacaucugcaauggcuuccagaagugcgaacaacugcucagagaguaugggcaguuuuguuccaaaauuaaccaggcucugcauggagccaaucuucgccaggaugacucuguucggaaccuguucgcuagcgugaaguccucucaaagcuccccuaucauucccggcuuugggggcgacuucaaucucacccugcuggagccugugagcaucucuacgggauccagaagcgcccgcucugcgaucgaagaucuucucuuugacaaagucacaauugccgaucccggcuacaugcagggguacgacgauugcaugcagcagggaccugcuuccgcccgggaccugaucugugcucaauauguggccggcuacaagguucugcccccgcucauggaugugaacauggaggccgcuuauaccagcucccugcuugggucuauugcgggagucggcuggaccgccgggcugagcuccuucgcugccaucccuuuugcccagagcauuuucuacagacucaauggcgugggaaucacacagcaaguucugucugaaaaccagaaacugaucgcuaauaaguuuaaccaggcccuuggcgcgaugcagaccggguucacaacgaccaaugaggcuuuucggaaggugcaagacgccgucaacaacaaugcccaggcucucuccaaacuggccagcgaacugucuaacacauucggagcgauuagcgcuuccaucggcgauauuauccagcgccucgacgugcuggagcaggaugcccaaauugacagacuuaucaaugggcggcugaccacacucaacgccuucguugcucagcagcuggugagaucugagagcgccgcucuguccgcccagcuugcgaaggauaaagucaaugaaugcgugaaggcccaaucuaaacgcagcggauuuuguggccagggcacccacaucguguccuucgucguuaacgcucccaaugggcuguauuuuaugcaugugggauacuauccuagcaaccacauugagguggucucugccuacggccucugcgacgcugccaaucccacgaacuguaucgccccggugaauggguacuucauuaagaccaacaauacacggaucguugacgaaugguccuauaccggaagcuccuuuuacucuccugagcccauuacaagccugaacaccaaguauguggcuccucaggucacauaccagaauaucuccaccaaccuucccccuccccugcuuggcaacucuacggggauugauuuccaagacgagcuggaugaauuuuucaaaaaugugagcacauccaucccgaacuuuggaagccucacccagaucaauaccacacugcuggaccuuaccuaugagaugcugucucuccagcaaguugugaaggcgcugaacgaauccuacauugaucucaaagagcugggcaauuauacguacuacaacaaguggcccugguauaucuggcuuggcuucauugccgggcuggucgcucucgcccugugcguguuuuucauccuguguugcacaggauguggcaccaauugcauggggaaacuuaagugcaacagauguugcgaccgcuacgaagaguaugaucuggagccucauaaaguccacgugcacuga

SEQ ID NO: 993 - RNA, 4062 nt, Artificial Sequence
  derived and/or modified CDS sequence (opt5) from MERS-CoV__AJG44102__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaagcuccugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaaacagucuuucuccaauccuaccugccuuauucuggccacagugagccacaaccucaccacaaucacgaagccccugaaauauucuuacaucaauaagugcagcagacuucuguccgaugaccggaccgaagucccccagcucgugaacgccaaucaauauagcccuuguguuucuauugugcccuccacagucugggaggacggggauuacuaccgcaaacagcugagcccgcuggaaggaggcggguggcucguggcuuccggaucuaccguugccaugacagagcagcugcagaugggcuuugggaucaccgugcaauauggcacggacaccaacagcgucugcccuaaacuugaguucgcgaaugauacaaagauugcuucccagcugggaaacuguguggaauacucucucuauggcgugagcgggagaggaguuuuucagaauugcaccgccgucggcgugcggcagcaaagauucguguacgacgccuaucagaaccuggucggguacuauuccgaugacggaaacuacuacugucugcgcgcuugcgugucuguucccgugagcgucaucuaugauaaggagacaaagacccaugccacgcuuuuuggcuccguggcuugugaacacauuagcucuacaaucucccaguacagccggucuaccagauccaugcucaaacgccgggacagcacauaugggccucugcagacccccguuggcugcgugcugggacucgucaauucuucccuguucguggaggauuguaaacuuccucugggccaaagccucugcgcccugcccgacaccccguccacacugacgccuagaagcguucgcucugugcccggggaaaugcggcuugcgagcauugccuuuaaccaccccauccaggucgaucagcucaauuccucuuacuucaagcugagcaucccuaccaacuuuuccuucggagugacacaagaguauauucagaccacaauccagaaggugaccgucgacuguaaacaguacguuugcaauggcuuccaaaagugcgaacagcugcucagagaguaugggcaguuuuguucuaagauuaaccaggcucugcauggagccaaucuucgccaagaugacagcgugcggaaccuguucgcuuccgugaaaucuagccaguccagcccgaucauucccggcuuugggggcgacuucaaucucacgcugcuggagccugucucuaucuccacaggaagcagaucugcccgcuccgcgaucgaagaucuucucuuugacaaggugaccauugccgaucccggcuacaugcagggguacgacgauugcaugcagcaaggaccugcuagcgcccgggaccugaucugugcucaguauguugccggcuacaaagugcugcccccucucauggaugucaacauggaggccgcuuauaccuccucucugcuugggagcauugcgggagugggcuggacagccgggcuguccagcuucgcugccauccccuuugcccagucuauuuucuacagacucaauggcguuggaaucacccaacaggugcuguccgaaaaccagaagcugaucgcuaauaaauuuaaccaggcccuuggcgcgaugcaaacaggguucacgaccacaaaugaggcuuuucggaagguccaggacgccgugaacaacaaugcccaggcucucagcaagcuggccucugaacugagcaacaccuucggagcgauuuccgcuucuaucggcgauauuauccagcgccucgacguucuggagcaagaugcccagauugacagacuuaucaaugggcggcugacaacccucaacgccuucguggcucagcagcuggucagaagcgaguccgccgcucugucugcccaacuugcgaaagauaaggugaaugaaugcgugaaagcccagagcaagcgcuccggauuuuguggccagggcacgcacaucgucagcuucguugugaacgcuccgaaugggcuguauuuuaugcaugugggauacuauccuucuaaccacauugaggucguguccgccuacggccucugcgacgcugccaaucccaccaacuguaucgccccuguuaauggguacuucauuaaaacaaacaauacccggaucguggacgaauggagcuauacaggauccucuuuuuacagccccgagccgauuaccucccugaacacaaaguaugucgcuccucaggugaccuaccaaaauaucucuacgaaccuucccccuccccugcuuggcaacagcacagggauugauuuccaggacgagcuggaugaauuuuucaagaauguuuccaccagcauccccaacuuuggaucucucacccagaucaauacaacccugcuggaccuuacguaugagaugcugucccuccaacagguggucaaagcgcugaacgaaagcuacauugaucucaaggagcugggcaauuauacauacuacaacaaauggccuugguauaucuggcuuggcuucauugccgggcugguggcucucgcccugugcgucuuuuucauccuguguugcaccggauguggcacaaauugcauggggaaacuuaagugcaacagauguugcgaccgcuacgaagaguaugaucuggagccgcauaaggugcacguucacuga

SEQ ID NO: 994 - RNA, 4062 nt, Artificial Sequence
  derived and/or modified CDS sequence (opt5) from MERS-CoV__AJG44124__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaauguuccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccagaagcguucgcuccgugcccggggaaaugcggcuugcgagcaucgccuucaaccacccuauucaggucgaucagcucaauucuagcuacuuuaagcuguccaucccgaccaacuucucuuucggagugacacaagaguauauccagaccacaauucagaaggugaccgucgacuguaaacaguacguuugcaauggcuuucaaaagugcgaacagcugcucagagaguaugggcaguucuguagcaagaucaaccaggcucugcauggagccaaucuucgccaagaugacuccgugcggaaccuguuugcuucugugaaaagcucccagucuagccccauuaucccuggcuucgggggcgacuuuaaucucacgcugcuggagcccgucuccauuagcacaggaucuagauccgcccgcagcgcgaucgaagaucuucucuucgacaaggugaccaucgccgauccuggcuacaugcagggguacgacgauugcaugcagcaaggacccgcuucugcccgggaccugauuugugcucaguauguugccggcuacaaagugcugccuccccucauggaugucaacauggaggccgcuuauaccuccagccugcuuggguccaucgcgggagugggcuggacagccgggcugucuagcuuugcugccauuccguucgcccaguccaucuuuuacagacucaauggcguuggaauuacccaacaggugcugagcgaaaaccagaagcugaucgcuaauaaauucaaccaggcccuuggcgcgaugcaaacaggguuuacgaccacaaaugaggcuuuccggaagguccaggacgccgugaacaacaaugcccaggcucucucuaagcuggccuccgaacugagcaacaccuucggagcgaucucugcuagcauuggcgauaucauucagcgccucgacguucuggagcaagaugcccagaucgacagacuuauuaaugggcggcugacaacccucaacgccuuuguggcucagcagcuggucagauccgagucugccgcucugagcgcccaacuugcgaaagauaaggugaaugaaugcgugaaagcccaguccaagcgcucuggauucuguggccagggcacgcacaucgucagcuuuguugugaacgcuccuaaugggcuguauuucaugcaugugggauacuaucccuccaaccacaucgaggucgugagcgccuacggccucugcgacgcugccaauccuaccaacuguauugcccccguuaauggguacuuuaucaaaacaaacaauacccggauuguggacgaauggucuuauacaggauccagcuucuacuccccggagccuaucaccucucugaacacaaaguaugucgcuccccaggugaccuaccaaaauauuagcacgaaccucccuccuccccugcuuggcaacuccacagggaucgauuuucaggacgagcuggaugaguucuuuaagaauguuucuaccagcauucccaacuucggaucccucacccagaucaauacaacccugcuggaccuuacguaugaaaugcugagccuccaacagguggucaaagcgcugaacgaaucuuacaucgaucucaaggagcugggcaauuauacauacuacaacaaauggccgugguauauuuggcuuggcuuuaucgccgggcugguggcucucgcccugugcgucuucuuuauucuguguugcaccggauguggcacaaauugcauggggaaacuuaagugcaacagauguugcgaccgcuacgaagaguaugaucuggagccccauaaggugcacguucacuga

SEQ ID NO: 995 - RNA, 4062 nt, Artificial Sequence
  derived and/or modified CDS sequence (opt5) from MERS-CoV__ALL26396__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguccguggaggauuguaaacuuccccugggccaaagccucugcgcccugccggacaccccuuccacacugacgcccagaagcguucgcucugugcccggggaaaugcggcuugcgagcaucgccuucaaccacccuauucaggucgaucagcucaauuccucuuacuuuaagcugagcaucccgaccaacuucuccuuuggagugacacaagaguauauccagaccacaauucagaaggugaccgucgacuguaaacaguacguuugcaauggcuuccaaaagugcgaacagcugcucagagaguaugggcaguucuguucuaagaucaaccaggcucugcauggagccaaucuucgccaagaugacagcgugcggaaccuguuugcuuccgugaaaucuagccaguccagccccauuaucccuggcuucgggggcgacuuuaaucucacgcugcuggagcccgucucuauuuccacaggaagcagaucugcccgcuccgcgaucgaagaucuucucuucgacaaggugaccaucgccgauccuggcuacaugcagggguacgacgauugcaugcagcaaggacccgcuagcgcccgggaccugauuugugcucaguauguugccggcuacaaagugcugccuccccucauggaugucaacauggaggccgcuuauaccuccucucugcuugggagcaucgcgggagugggcuggacagccgggcuguccagcuuugcugccauuccguucgcccagucuaucuuuuacagacucaauggcguuggaauuacccaacaggugcuguccgaaaaccagaagcugaucgcuaauaaauucaaccaggcccuuggcgcgaugcaaacaggguuuacgaccacaaaugaggcuuuccggaagguccaggacgccgugaacaacaaugcccaggcucucagcaagcuggccucugaacugagcaacaccuuuggagcgaucuccgcuucuauuggcgauaucauucagcgccucgacguucuggagcaagaugcccagaucgacagacuuauuaaugggcggcugacaacccucaacgccuucguggcucagcagcuggucagaagcgaguccgccgcucugucugcccaacuugcgaaagauaaggugaaugaaugcgugaaagcccagagcaagcgcuccggauucuguggccagggcacgcacaucgucagcuuuguugugaacgcuccuaaugggcuguauuucaugcaugugggauacuaucccucuaaccacaucgaggucguguccgccuacggccucugcgacgcugccaauccuaccaacuguauugcccccguuaauggguacuuuaucaaaacaaacaauacccggauuguggacgaauggagcuauacaggauccucuuucuacgcuccggagccuaucaccagccugaacacaaaguaugucgcgccccaggugaccuaccaaaauauuuccacgaaccucccuccuccccugcuuucuaacagcacaggcaucgauuuucaggacgagcuggaugaguucuuuaagaauguuuccaccagcauucccaacuucgggucucucacccagaucaauacaacccugcuggaccuuacguaugaaaugcugucccuccaacagguggucaaagcccugaacgaaagcuacaucgaucucaaggagcugggaaauuauacauacuacaacaaauggccgugguauauuuggcuuggcuuuaucgcuggccugguggcccucgcccugugcgucuucuuuauucuguguugcaccggguguggaacaaauugcaugggcaaacuuaagugcaacagauguugcgaccgcuacgaagaguaugaucuggagccccauaaggugcacguucacuga

SEQ ID NO: 996 - RNA, 4062 nt, Artificial Sequence
  derived and/or modified CDS sequence (opt5) from MERS-CoV__ALS20350__S
augauccacagcguguuccugcucauguuucugcuuacccccacagaguccuacgucgacguuggcccugauucugccaagagcgcuugcauugaaguggacauccagcaaacguucuuugauaaaaccuggccgagacccauugacguguccaaggccgaugggaucauuuauccucagggacggacauacucuaacaucaccaucacauaucagggccuguuccccuaccagggggaccauggagauauguaugucuacagcgcgggccacgcuaccgggacaaccccucaaaaacucuuuguggccaauuauucccaggacguuaagcaguucgccaacggauuugugguccgcauuggcgcugccgcuaauucuacgggcaccgugaucauuagccccuccacaagcgccaccaucagaaaaauuuacccugcguucaugcuggggucuuccguuggaaacuuuagcgauggcaagauggggcgguucuuuaaucauacacuugugcugcucccggacggauguggcacccugcugcgcgccuucuacugcauccucgagcccagaucugggaacuauuguccugcuggaaauuccuacacgagcuuugccacauaucacacccccgcuacagauugcucugacggcaacuacaaucggaacgccucccugaauagcuucaaggaauauuucaaccuucgcaauuguaccuuuauguacaccuauaacauuacagaggaugaaauccuggagugguucggcaucacgcagaccgcgcaagggguccaucucuuuuccucuagauacguggaccuguacggaggcaauauguuccaguuugccacacuuccuguguaugacaccauuaaauacuauagcaucauuccccacuccauccggagcauucagucugaucgcaaggcuugggccgcuuucuacgucuauaaacugcagccgcucacauuucugcuggacuucuccguugauggguacaucagacgggccaucgacugcggauuuaacgaucucagccaacugcacuguucuuaugagagcuucgacguggaauccggcguguacucugucagcuccuuugaggccaagccuagcgggucugugguugaacaggcugagggaguggagugcgauuucagcccccuucugagcggcaccccuccccaggucuacaacuuuaaacgccucguguucacgaauuguaacuauaaucugacaaaacuucugucucucuucuccguuaacgacuuuaccugcagccaaauuucccccgcggccaucgcuucuaauuguuacagcucccugauucuggauuauuucucuuacccucucagcaugaaguccgaccugagcgugucuuccgccggcccgaucagccaguuuaacuauaagcagucuuucuccaauccuaccugccuuauucuggccacagucccccauaaccucaccacaaucacgaagccccugaaauacagcuauaucaauaagugcucuagacuucugagcgaugaccggaccgaagugccucagcucgucaacgcuaaucaauacucccccugugugagcauuguuccgucuacagugugggaggacggggauuacuaucgcaaacagcuguccccucuggaaggaggcggguggcucgucgccagcggauccaccguggcgaugacagagcagcugcagaugggcuuugggaucaccguucaauacggcacggacaccaacucugugugccccaaacuugaguucgcuaaugauacaaagauugccagccagcugggaaacugugucgaauauucccucuacggcgugucugggagaggaguguuucagaauugcaccgccguuggcguccggcagcaaagauucguguaugacgcuuaccagaaccuggugggguauuacagcgaugacggaaacuacuauugucugcgcgccugcgucacagugccuguuuccgugaucuacgauaaggagaccaagacgcacgcuacacuuuuuggcucugucgccugugaacauauuagcuccaccaugagccaguauucucgguccacaagaagcaugcucaaacgccgggacucuaccuacgggccccugcagaccccugugggcugcguucugggacucgucaauuccagccuguucguggaggauuguaaacuuccccugggccaaucucucugcgcgcugccggacacaccuuccacgcugacccccagaagcgugcgcuccguucccggggaaaugcggcuugccagcaucgcuuuuaaccacccuauucagguggaucagcucaauucuagcuauuucaagcuguccaucccgacaaacuuuucuuucggagucacccaagaguacauccagacaaccauucagaaggugacgguggacuguaaacaguaugucugcaauggcuuccaaaagugcgaacagcugcucagagaguacgggcaguuuuguagcaagaucaaccaggcccugcacggagcuaaucuucgccaagaugacuccguucggaaccuguucgccucugugaaaagcuaccaguccucucccauuaucccuggcuuugggggcgacuucaaucucacacugcuggagcccgugagcauuuccaccggaagcagaucugcgcgcuccgccaucgaagaucuucucuuugacaaggucaccaucgcugauccuggcuauaugcagggguacgacgauugcaugcaucagggacccgccagcgcucgggaccugauuugugcccaauauguggccggcuacaaaguucugccuccccucauggaugugaacauggaggcugcguauacaucuucccugcuugggagcaucgccggagucggcuggaccgcugggcuguccucuuucgccgccauuccguuugcucagagcaucuucuacagacucaauggcgugggaauuacacagcaaguucuguccgaaaaccagaagcugaucgccaauaaauuuaaccaggcgcuuggcgcuaugcagacgggguucaccacaaccaaugaggccuuucaaaaggugcaggacgccgucaacaacaaugcucaggcccucagcaagcuggcgucugaacuguccaacacauucggagcuaucagcgccucuauuggcgauaucauucagcggcucgacgugcuggagcaagaugcccagaucgaccgccuuauuaaugggagacugaccacgcucaacgcuuucguugcccagcagcuggugcggagcgaguccgcugcccugucugcgcaacuugccaaagauaaggucaaugaaugcgugaaagcucagagcaagagauccggauuuuguggccagggcacccacaucgugucuuucgucguuaacgccccuaaugggcuguauuuuaugcaugugggauacuaccccagcaaccacaucgagguggucuccgcuuauggccucugcgaccuggccaauccuacaaacuguauugcccccgugaauggguacuucaucaaaaccaacaauacacgcauuguugacgaauggagcuauaccggaucuuccuuuuacgcuccggagccuaucacauccuucaacaccaaguauguggcgccccaggucacguaccaaaauauuuccacaaaccucccuccuccccugcuuggcaacucuaccgggaucgauuuucaggacgagcuggaugaguucuuuaagaaugugagcaccuccauucccaacuucggaucucucacacagaucaauaccacgcugcuggaccuuacauaugaaaugcugagccuccaacagguugugaaagcccugaacgaauccuacaucgaucucaaggagcugggcaauuacaccuauuacaacaaauggccgugguauauuuggcuuggcuuuaucgcugggcuggucgcccucgcccugugcguguucuuuauucuguguugcacaggauguggcaccaauugcauggggaaacuuaagugcaaccgguguugcgacagauacgaagaguaugaucuggagccccauaagguccacgugcacuga

SEQ ID NO: 997 - RNA, 4062 nt, Artificial Sequence
  derived and/or modified CDS sequence (opt5) from MERS-CoV__ALT66880__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacucuccggagccuaucaccagccugaacacaaaguaugucgcuccccaggugaccuaccaaaauauuuccacgaaccucccuccuccccugcuuggcaacucuacagggaucgauuuccaggacgagcuggaugaauuuuucaagaauguuagcaccuccauucccaacuuuggaagccucacccagaucaauacaacccugcuggaccuuacguaugagaugcugucucuccaacagguggucaaagcgcugaacgaauccuacaucgaucucaaggagcugggcaauuauacauacuacaacaaauggccgugguauauuuggcuuggcuucaucgccgggcugguggcucucgcccugugcgucuuuuucauucuguguugcaccggauguggcacaaauugcauggggaaacuuaagugcaacagauguugcgaccgcuacgaagaguaugaucuggagccccauaaggugcacguucacuga

SEQ ID NO: 998 - RNA, 4062 nt, Artificial Sequence
  derived and/or modified CDS sequence (opt5) from MERS-CoV__ALA49341__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaacccuccaaaaacuguuuguugcuaauuauucccaggacgugaagcaguucgccaacggauuugucgugcgcauuggcgccgcugccaauucuacgggcaccguuaucauuagcccuuccacaagcgcuaccaucagaaaaauuuaccccgccuucaugcuugggucuuccgugggaaacuuuagcgauggcaagauggggcgguucuuuaaucauacacugguccuccugccugacggauguggcacccugcuccgcgcguucuacugcauccuggagccgagaucugggaaccacugucccgccggaaauuccuauacgagcuuugcuacauaccauaccccugccacagauugcucugacggcaacuauaaucggaacgcuucccuuaauagcuucaaggaauacuucaaccugcgcaauuguaccuuuauguauaccuacaacauuacagaggaugaaauccucgagugguucggcaucacgcagaccgcccaaggggugcaccuguuuuccucuagauauguggaccuuuacggaggcaauauguuccaguuugcgacacugcccgucuacgacaccauuaaauauuacagcaucauuccucacuccauccggagcauucagucugaucgcaaggccugggcugccuucuauguuuacaaacuccagccccugacauuucugcucgacuucuccguggauggguauaucagacgggcuaucgacugcggauuuaacgaucugagccaacuucauuguucuuacgagagcuucgacguggaauccggcgucuauucugugagcuccuuugaggccaagccgagcgggucuguuguggaacaggccgagggagucgagugcgauuucuccccucugcucagcggcacgcccccucagguguacaacuuuaaacgccugguuuucaccaauuguaacuacaaucuuacaaagcugcucucucuguucuccgugaacgacuuuauuugcagccaaaucucccccgcugcgauugccucuaauuguuauagcucccugauccucgauuacuucucuuauccccugagcaugaaguccgaccuuagcgucucuuccgcuggcccuauuagccaguuuaacuacaaacagucuuucuccaauccgaccugccugauccucgccaccgugccccacaaccugacaaccaucacaaagccucuuaaauauagcuacauuaauaagugcucuagacugcucagcgaugaccggacggaagucccccagcuggugaacgccaaucaauauuccccuuguguuagcaucgugcccucuaccgucugggaggacggggauuacuaccgcaaacagcuguccccgcucgaaggaggcggguggcugguggcuagcggauccacaguugccaugaccgagcagcuucagaugggcuuugggauuacagugcaauauggcaccgacacgaacucugucugcccuaagcuggaguucgcgaaugauaccaaaaucgcuagccagcucggaaacuguguggaauacucccuguauggcgugucugggagaggaguuuuucagaauugcacagccgucggcgugcggcagcaaagauucguguacgacgccuaucagaaccuggucggguacuauagcgaugacggaaacuacuacugucuucgcgcuugcguguccguucccgugucugucauuuaugauaaggagaccaagacacaugccacccucuuuggcagcguggcuugugaacacaucuccagcacgaugucucaguacucccggagcacaagaucuaugcugaaacgccgggacuccaccuaugggccucugcagacacccguuggcugcgugcucggacuggucaauagcucucuuuucguggaggauuguaagcugccucucggccaaucccugugcgcccugcccgacaccccgagcacccuuacaccuagauccguucgcagcgugcccggggaaaugcggcucgcgucuauugccuuuaaccaccccauccaggucgaucagcugaauagcuccuacuucaaacugucuaucccuacgaacuuuagcuucggagugacccaagaguauauucagacaaccauccagaaggugacagucgacuguaaacaguacguuugcaauggcuuccaaaagugcgaacagcuccugagagaguaugggcaguuuuguuccaagauuaaccaggcccuucauggagcuaaucugcgccaagaugacucugugcggaaccucuucgcuagcgugaaauccucucagagcuccccgaucauucccggcuuugggggcgacuucaaucugacccugcuugagccugucagcaucucuacgggauccagaagcgcccgcucugcgaucgaagaucuccuguuugacaaggugacaauugccgaucccggcuacaugcagggguacgacgauugcaugcagcaaggaccugcuuccgcccgggaccugaucugugcucaguauguugccggcuacaaagugcuucccccucugauggaugucaacauggaggccgcuuauaccagcucccuucuggggucuauugcgggagugggcuggaccgccgggcucagcuccuucgcugccauccccuuugcccagagcauuuucuacagacugaauggcguuggaaucacacaacaggugcugucugaaaaccagaagcucaucgcuaauaaauuuaaccaggcccucggcgcgaugcaaaccggguucacaacgaccaaugaggcuuuucggaagguccaggacgccgugaacaacaaugcccaggcucuguccaagcuggccagcgaacucucuaacacauucggagcgauuagcgcuuccaucggcgauauuauccagcgccuggacguucuugagcaagaugcccagauugacagacugaucaaugggcggcucaccacacugaacgccuucguggcucagcagcuggucagaucugagagcgccgcucuuuccgcccaacuggcgaaagauaaggugaaugaaugcgugaaagcccagucuaagcgcagcggauuuuguggccagggcacccacaucgucuccuucguugugaacgcuccgaaugggcucuauuuuaugcaugugggauacuauccuagcaaccacauugaggucgugucugccuacggccugugcgacgcugccaaucccacgaacuguaucgccccuguuaauggguacuucauuaaaaccaacaauacacggaucguggacgaaugguccuauaccggaagcuccuuuuacgcucccgagccgauuacaucucucaacaccaaguaugucgcgccucaggugacauaccaaaauaucagcaccaaccugcccccuccccuucugggcaacuccacggggauugauuuccaggacgagcucgaugaauuuuucaagaauguuucuacaagcauccccaacuuuggaucccugacccagaucaauaccacacugcuugaccugaccuaugagaugcucagccugcaacagguggucaaagcccucaacgaaucuuacauugaucugaaggagcuuggcaauuauacguacuacaacaaauggccuugguauaucuggcugggcuucauugcugggcucguggcccuggcccugugcgucuuuuucauccuuuguugcacaggauguggcaccaauugcauggggaagcugaaaugcaacagauguugcgaccgcuacgaagaguaugaucucgagccgcauaaggugcacguucacuga

SEQ ID NO: 999 - RNA, 4062 nt, Artificial Sequence
  derived and/or modified CDS sequence (opt5) from MERS-CoV__ALA49352__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauacuauacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuacuauugucugcgcgcuugcguguccguuccugugucugucaucuacgauaaggagacaaagacccacgccacgcuuuuuggcagcguggcuugugaacauauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuauuucaagcugucuaucccgaccaacuuuagcuucggagugacacaagaguacauccagaccacaauucagaaggugaccgucgacuguaaacaguauguuugcaauggcuuccaaaagugcgaacagcugcucagagaguacgggcaguuuuguuccaagaucaaccaggcucugcacggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguaugacgauugcaugcagcaaggacccgcuuccgcccgggaccugauuugugcucaguacguugccggcuauaaagugcugccuccccucauggaugucaacauggaggccgcuuacaccagcucccugcuugggucuaucgcgggagugggcuggacagccgggcugagcuccuucgcugccauuccguuugcccagagcaucuucuauagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcauaucgucuccuucguugugaacgcuccuaaugggcuguacuuuaugcacgugggauauuaccccagcaaccauaucgaggucgugucugccuacggccucugcgacgcugccaauccuaccaacuguauugcccccguuaauggguauuucaucaaaacaaacaauacccggauuguggacgaaugguccuacacaggaagcuccuuuuaugcuccggagccuaucaccucucugaacacaaaguacgucgcgccccaggugaccuaucaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguacgagaugcugagccuccaacagguggucaaagcccugaacgaaucuuauaucgaucucaaggagcugggcaauuacacauacuauaacaaauggccgugguacauuuggcuuggcuucaucgcugggcugguggcccucgcccugugcgucuuuuucauucuguguugcaccggauguggcacaaauugcauggggaaacuuaagugcaacagauguugcgaccgcuaugaagaguacgaucuggagccccacaaggugcauguucacuga

SEQ ID NO: 1000 - RNA, 4062 nt, Artificial Sequence
  derived and/or modified CDS sequence (opt5) from MERS-CoV__ALA49363__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacauucccugucuacgacaccauuaaauauuacagcaucauuccccacuccauccggagcauucagucugaucgcaaggccugggcugccuuuuauguuuacaaacuucagccgcugacauuccuccuggacuuuuccguggauggguauaucagacgggcuaucgacugcggauucaacgaucugagccaacuccauuguucuuacgagagcuuugacguggaauccggcgucuauucugugagcuccuucgaggccaagccuagcgggucuguuguggaacaggccgagggagucgagugcgauuuuagcccccugcuuagcggcaccccuccccagguguacaacuucaaacgccugguuuucacgaauuguaacuacaaucucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccagauccguucgcagcgugcccggggaaaugcggcuggcgucuaucgccuucaaccacccuauucaggucgaucagcuuaauagcuccuacuuuaaacucucuaucccgaccaacuucagcuucggagugacacaagaguauauccagaccacaauucagaaggugaccgucgacuguaaacaguacguuugcaauggcuuucaaaagugcgaacagcugcugagagaguaugggcaguucuguuccaagaucaaccaggcucuccauggagccaaucugcgccaagaugacucugugcggaaccuuuuugcuagcgugaaauccucucagagcucccccauuaucccuggcuucgggggcgacuuuaaucugacgcuccuggagcccgucagcauuucuacaggauccagaagcgcccgcucugcgaucgaagaucugcuuuucgacaaggugaccaucgccgauccuggcuacaugcagggguacgacgauugcaugcagcaaggacccgcuuccgcccgggaccucauuugugcucaguauguugccggcuacaaagugcugccuccccugauggaugucaacauggaggccgcuuauaccagcucccuccuggggucuaucgcgggagugggcuggacagccgggcuuagcuccuuugcugccauuccguucgcccagagcaucuuuuacagacugaauggcguuggaauuacccaacaggugcucucugaaaaccagaagcugaucgcuaauaaauucaaccaggcccugggcgcgaugcaaacaggguuuacgaccacaaaugaggcuuuccggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuuuguggcucagcagcucgucagaucugagagcgccgcucuguccgcccaacuggcgaaagauaaggugaaugaaugcgugaaagcccagucuaagcgcagcggauucuguggccagggcacgcacaucgucuccuuuguugugaacgcuccuaaugggcuuuauuucaugcaugugggauacuaucccagcaaccacaucgaggucgugucugccuacggccugugcgacgcugccaauccuaccaacuguauugcccccguuaauggguacuuuaucaaaacaaacaauacccggauuguggacgaaugguccuauacaggaagcuccuucuacgcuccggagccuaucaccucucucaacacaaaguaugucgcgccccaggugaccuaccaaaauauuagcacgaaccugccuccuccccuccugggcaacuccacagggaucgauuuucaggacgagcuugaugaguucuuuaagaauguuucuaccagcauucccaacuucggaucccugacccagaucaauacaacccuccuggaccugacguaugaaaugcuuagccugcaacagguggucaaagcccucaacgaaucuuacaucgaucugaaggagcucggcaauuauacauacuacaacaaauggccgugguauauuuggcugggcuuuaucgcugggcuuguggcccuggcccucugcgucuucuuuauucuguguugcaccggauguggcacaaauugcauggggaagcugaaaugcaacagauguugcgaccgcuacgaagaguaugaucuugagccccauaaggugcacguucacuga

SEQ ID NO: 1001 - RNA, 4062 nt, Artificial Sequence
  derived and/or modified CDS sequence (opt5) from MERS-CoV__ALA49374__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccagauccguucgcagcgugcccggggaaaugcggcuggcgucuaucgccuucaaccacccuauucaggucgaucagcuuaauagcuccuacuuuaaacucucuaucccgaccaacuucagcuucggagugacacaagaguauauccagaccacaauucagaaggugaccgucgacuguaaacaguacguuugcaauggcuuucaaaagugcgaacagcugcugagagaguaugggcaguucuguuccaagaucaaccaggcucuccauggagccaaucugcgccaagaugacucugugcggaaccuuuuugcuagcgugaaauccucucagagcucccccauuaucccuggcuucgggggcgacuuuaaucugacgcuccuggagcccgucagcauuucuacaggauccagaagcgcccgcucugcgaucgaagaucugcuuuucgacaaggugaccaucgccgauccuggcuacaugcagggguacgacgauugcaugcagcaaggacccgcuuccgcccgggaccucauuugugcucaguauguugccggcuacaaagugcugccuccccugauggaugucaacauggaggccgcuuauaccagcucccuccuggggucuaucgcgggagugggcuggacagccgggcuuagcuccuuugcugccauuccguucgcccagagcaucuuuuacagacugaauggcguuggaauuacccaacaggugcucucugaaaaccagaagcugaucgcuaauaaauucaaccaggcccugggcgcgaugcaaacaggguuuacgaccacaaaugaggcuuuccggaagguccaggacgccgugaacaacaaugcccaggcucuuuccaagcucgccagcgaacugucuaacaccuucggagcgaucagcgcuuccauuggcgauaucauucagcgccuggacguucucgagcaagaugcccagaucgacagacugauuaaugggcggcuuacaacccugaacgccuuuguggcucagcagcucgucagaucugagagcgccgcucuguccgcccaacuggcgaaagauaaggugaaugaaugcgugaaagcccagucuaagcgcagcggauucuguggccagggcacgcacaucgucuccuuuguugugaacgcuccuaaugggcuuuauuucaugcaugugggauacuaucccagcaaccacaucgaggucgugucugccuacggccugugcgacgcugccaauccuaccaacuguauugcccccguuaauggguacuuuaucaaaacaaacaauacccggauuguggacgaaugguccuauacaggaagcuccuucuacgcuccggagccuaucaccucucucaacacaaaguaugucgcgccccaggugaccuaccaaaauauuagcacgaaccugccuccuccccuccuguccaacucuacaggcaucgauuuucaggacgagcuugaugaguucuuuaagaauguuagcaccuccauucccaacuucgggagccugacccagaucaauacaacccuccuggaccugacguaugaaaugcuuucucugcaacagguggucaaagcccucaacgaauccuacaucgaucugaaggagcucggaaauuauacauacuacaacaaauggccgugguauauuuggcugggcuuuaucgcuggccuuguggcccuggcccucugcgucuucuuuauucuguguugcaccggguguggaacaaauugcaugggcaagcugaaaugcaacagauguugcgaccgcuacgaagaguaugaucuugagccccauaaggugcacguucacuga

SEQ ID NO: 1002 - RNA, 4062 nt, Artificial Sequence
  derived and/or modified CDS sequence (opt5) from MERS-CoV__ALA49396__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuccagcaauccuaccugccuuauucuggccacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggcuuccggaucuaccguugccaugacagagcagcugcagaugggcuucgggaucaccgugcaauauggcacggacaccaacagcgucugccccaaacuugaauuugcgaaugauacaaagauugcuucccagcugggaaacuguguggaguacucucucuauggcgugagcgggagaggaguuuuccagaauugcaccgccgucggcgugcggcagcaaagauuuguguacgacgccuaucagaaccuggucggguacuauuccgaugacggaaacuacuacugucugcgcgcuugcgugucuguuccugugagcgucaucuaugauaaggagacaaagacccaugccacgcuuuucggcuccguggcuugugaacacauuagcucuacaaugucccaguacagccggucuaccagauccaugcucaaacgccgggacagcacauaugggccccugcagaccccuguuggcugcgugcugggacucgucaauucuucccuguuuguggaggauuguaaacuuccccugggccaaagccucugcgcccugccggacaccccuuccacacugacgcccagaagcguucgcucugugcccggggaaaugcggcuugcgagcaucgccuucaaccacccuauucaggucgaucagcucaauuccucuuacuuuaagcugagcaucccgaccaacuucuccuuuggagugacacaagaguauauccagaccacaauucagaaggugaccgucgacuguaaacaguacguuugcaauggcuuccaaaagugcgaacagcugcucagagaguaugggcaguucuguucuaagaucaaccaggcucugcauggagccaaucuucgccaagaugacagcgugcggaaccuguuugcuuccgugaaaucuagccaguccagccccauuaucccuggcuucgggggcgacuuuaaucucacgcugcuggagcccgucucuauuuccacaggaagcagaucugcccgcuccgcgaucgaagaucuucucuucgacaaggugaccaucgccgauccuggcuacaugcagggguacgacgauugcaugcagcaaggacccgcuagcgcccgggaccugauuugugcucaguauguugccggcuacaaagugcugccuccccucauggaugucaacauggaggccgcuuauaccuccucucugcuugggagcaucgcgggagugggcuggacagccgggcuguccagcuuugcugccauuccguucgcccagucuaucuuuuacagacucaauggcguuggaauuacccaacaggugcuguccgaaaaccagaagcugaucgcuaauaaauucaaccaggcccuuggcgcgaugcaaacaggguuuacgaccacaaaugaggcuuuccggaagguccaggacgccgugaacaacaaugcccaggcucucagcaagcuggccucugaacugagcaacaccuuuggagcgaucuccgcuucuauuggcgauaucauucagcgccucgacguucuggagcaagaugcccagaucgacagacuuauuaaugggcggcugacaacccucaacgccuucguggcucagcagcuggucagaagcgaguccgccgcucugucugcccaacuugcgaaagauaaggugaaugaaugcgugaaagcccagagcaagcgcuccggauucuguggccagggcacgcacaucgucagcuuuguugugaacgcuccuaaugggcuguauuucaugcaugugggauacuaucccucuaaccacaucgaggucguguccgccuacggccucugcgacgcugccaauccuaccaacuguauugcccccguuaauggguacuuuaucaaaacaaacaauacccggauuguggacgaauggagcuauacaggauccucuuucuacgcuccggagccuaucaccagccugaacacaaaguaugucgcgccccaggugaccuaccaaaauauuuccacgaaccucccuccuccccugcuuucuaacagcacaggcaucgauuuucaggacgagcuggaugaguucuuuaagaauguuuccaccagcauucccaacuucgggucucucacccagaucaauacaacccugcuggaccuuacguaugaaaugcugucccuccaacagguggucaaagcccugaacgaaagcuacaucgaucucaaggagcugggaaauuauacauacuacaacaaauggccgugguauauuuggcuuggcuuuaucgcuggccugguggcccucgcccugugcgucuucuuuauucuguguugcaccggguguggaacaaauugcaugggcaaacuuaagugcaacagauguugcgaccgcuacgaagaguaugaucuggagccccauaaggugcacguucacuga

SEQ ID NO: 1003 - RNA, 4062 nt, Artificial Sequence
  derived and/or modified CDS sequence (opt5) from MERS-CoV__ALA49451__S
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaccuuccccugggccaaucccucugcgcccugccggacaccccuagcacacugacgcccagauccguucgcagcgugcccggggaaaugcggcuugcgucuaucgccuuuaaucacccuauucaggucgaucagcucaacagcuccuacuucaagcugucuaucccgaccaauuuuagcuucggagugacacaagaguauauccagaccacaauucagaaagugaccgucgacuguaagcaguacguuugcaacggcuuccaaaaaugcgaacagcugcucagagaguaugggcaguuuuguuccaagaucaaucaggcucugcauggagccaaccuucgccaagaugacucugugcggaaucuguucgcuagcgugaaguccucucagagcucccccauuaucccuggcuuugggggcgacuucaaccucacgcugcuggagcccgucagcauuucuacaggauccagaagcgcccgcucugcgaucgaagaucuucucuuugacaaagugaccaucgccgauccuggcuacaugcagggguacgacgauugcaugcagcaaggacccgcuuccgcccgggaccugauuugugcucaguauguugccggcuacaaggugcugccuccccucauggaugucaauauggaggccgcuuauaccagcucccugcuugggucuaucgcgggagugggcuggacagccgggcugagcuccuucgcugccauuccguuugcccagagcaucuucuacagacucaacggcguuggaauuacccaacaggugcugucugaaaaucagaaacugaucgcuaacaaguuuaaucaggcccuuggcgcgaugcaaacaggguucacgaccacaaacgaggcuuuucggaaaguccaggacgccgugaacaauaacgcccaggcucucuccaagcuggccagcgaacugucuaauaccuucggagcgaucagcgcuuccauuggcgauaucauucagcgccucgacguucuggagcaagaugcccagaucgacagacuuauuaacgggcggcugacaacccucaaugccuucguggcucagcagcuggucagaucugagagcgccgcucuguccgcccaacuugcgaaggauaaagugaacgaaugcgugaaggcccagucuaaacgcagcggauuuuguggccagggcacgcacaucgucuccuucguugugaaugcuccuaacgggcuguauuuuaugcaugugggauacuaucccagcaaucacaucgaggucgugucugccuacggccucugcgacgcugccaacccuaccaauuguauugcccccguuaacggguacuucaucaagacaaauaacacccggauuguggacgaaugguccuauacaggaagcuccuuuuacgcuccggagccuaucaccucucugaauacaaaauaugucgcgccccaggugaccuaccaaaacauuagcacgaaccucccuccuccccugcuuggcaauuccacagggaucgauuuccaggacgagcuggaugaauuuuucaagaacguuucuaccagcauucccaauuuuggaucccucacccagaucaacacaacccugcuggaccuuacguaugagaugcugagccuccaacagguggucaaggcccugaaugaaucuuacaucgaucucaaagagcugggcaacuauacauacuacaauaaguggccgugguauauuuggcuuggcuucaucgcugggcugguggcccucgcccugugcgucuuuuucauucuguguugcaccggauguggcacaaacugcauggggaaacuuaagugcaauagauguugcgaccgcuacgaagaguaugaucuggagccccauaaagugcacguucacuga

SEQ ID NO: 1004 - RNA, 4062 nt, Artificial Sequence
  derived and/or modified CDS sequence (opt5) from MERS-CoV__ALA49473__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccacaaccgauugcucugacggcaacuauaaucggaacgccucccugaauagcuucaaggaauacuucaaccuucgcaauuguaccuuuauguauacauacaacauuacggaggaugaaauccuggagugguucggcaucacccagacagcucaaggggugcaccucuuuuccucuagauauguggaccuguacggaggcaauauguuccaguuugccacccuuccugucuacgacacaauuaaauauuacagcaucauuccccacuccauccggagcauucagucugaucgcaaggcgugggccgcuuucuauguuuacaaacugcagccgcucaccuuucugcuggacuucuccguggauggguauaucagacgggccaucgacugcggauuuaacgaucucagccaacugcauuguucuuacgagagcuucgacguggaauccggcgucuauucugugagcuccuuugaggcuaagccuagcgggucuguuguggaacaggccgagggagucgagugcgauuucagcccccuucuguccggcacgccuccccagguguacaacuuuaaacgccucguuuucacaaauuguaacuacaaucugaccaaacuucugucucucuucuccgugaacgacuuuaccugcagccaaauuucccccgccgcuaucgcgucuaauuguuauagcucccugauucuggauuacuucucuuauccucucagcaugaaguccgaccugagcgucucuuccgccggcccgaucagccaguuuaacuacaagcagucuuucuccaaucccacaugccuuauucuggcuaccgugccucacaaccucacaacgaucaccaagccccugaaauauagcuacaucaauaagugcucuagacuucugagcgaugaccggacagaagucccucagcucgugaacgccaaucaauauucccccuguguuagcauugugccgucuaccgucugggaggacggggauuacuaccgcaaacagcuguccccucuggaaggaggcggguggcucguggccagcggauccacaguugcuaugaccgagcagcugcagaugggcuuugggaucacggugcaauauggcaccgacacaaacucugucugccccaaacuugaguucgccaaugauaccaagauugcgagccagcugggaaacuguguggaauacucccucuauggcgugucugggagaggaguuuuucagaauugcacagcugucggcgugcggcagcaaagauucguguacgacgccuaucagaaccuggucggguacuauagcgaugacggaaacuacuacugucugcgcgccugcguguccguuccugugucugucaucuaugauaaggagaccaagacgcaugcuacacuuuuuggcagcguggccugugaacacauuuccagcaccaugucucaguacucccggagcacaagaucuaugcucaaacgccgggacuccaccuaugggccccugcagaccccuguuggcugcgugcugggacucgucaauagcucucuguucguggaggauuguaaacuuccccugggccaaucccucugcgcucugccggacacaccuagcacgcugacccccagauccguucgcagcgugcccggggaaaugcggcuugccucuaucgcguuuaaccacccuauucaggucgaucagcucaauagcuccuacuucaagcugucuaucccgacaaacuuuagcuucggagugacccaagaguauauccagacaaccauucagaaggugacggucgacuguaaacaguacguuugcaauggcuuccaaaagugcgaacagcugcucagagaguaugggcaguuuuguuccaagaucaaccaggcccugcauggagcuaaucuucgccaagaugacucugugcggaaccuguucgccagcgugaaauccucucagagcucccccauuaucccuggcuuugggggcgacuucaaucucacacugcuggagcccgucagcauuucuaccggauccagaagcgcucgcucugccaucgaagaucuucucuuugacaaggugaccaucgcggauccuggcuacaugcagggguacgacgauugcaugcagcaaggacccgccuccgcucgggaccugauuugugcccaguauguugcuggcuacaaagugcugccuccccucauggaugucaacauggaggccgccuauacaagcucccugcuugggucuaucgcuggagugggcuggaccgcggggcugagcuccuucgccgcuauuccguuugcccagagcaucuucuacagacucaauggcguuggaauuacacaacaggugcugucugaaaaccagaagcugaucgccaauaaauuuaaccaggcucuuggcgccaugcaaacgggguucaccacaaccaaugaggcguuucggaagguccaggacgcugugaacaacaaugcccaggcccucuccaagcuggcuagcgaacugucuaacacauucggagccaucagcgcguccauuggcgauaucauucagcgccucgacguucuggagcaagaugcucagaucgacagacuuauuaaugggcggcugaccacgcucaacgccuucguggcccagcagcuggucagaucugagagcgcugcccuguccgcucaacuugccaaagauaaggugaaugaaugcgugaaagcgcagucuaagcgcagcggauuuuguggccagggcacccacaucgucuccuucguugugaacgccccuaaugggcuguauuuuaugcaugugggauacuaucccagcaaccacaucgaggucgugucugcuuacggccucugcgacgccgcuaauccuacaaacuguauugcccccguuaauggguacuucaucaaaaccaacaauacacggauuguggacgaaugguccuauaccggaagcuccuuuuacgccccggagccuaucacaucucugaacaccaaguaugucgcuccccaggugacguaccaaaauauuagcacaaaccucccuccuccccugcuuggcaacuccaccgggaucgauuuccaggacgagcuggaugaauuuuucaagaauguuucuaccagcauucccaacuuuggaucccucacacagaucaauaccacgcugcuggaccuuacauaugagaugcugagccuccaacagguggucaaagcgcugaacgaaucuuacaucgaucucaaggagcugggcaauuauaccuacuacaacaaauggccgugguauauuuggcuuggcuucaucgccgggcugguggcucucgcccugugcgucuuuuucauucuguguugcacaggauguggcaccaauugcauggggaaacuuaaguuuaacagaugcugugaccgcuacgaagaguaugaucuggagccccauaaggugcacguucacuga

SEQ ID NO: 1005 - RNA, 4062 nt, Artificial Sequence
  derived and/or modified CDS sequence (opt5) from MERS-CoV__ALA49583__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaggugaccuaccaaaauauuagcacgaaccucccuccuccccugcuuggcaacuccacagggaucgauuuccaggacgagcuggaugaauuuuucaagaauguuucuaccagcauucccaacuuuggaucccucacccagaucaauacaacccugcuggaccuuacguaugagaugcugagccuccaacagguggucaaagcccugaacgaaucuuacaucgaucucaaggagcugggcaauuauacauacuacaacaaauggccgugguauauuuggcuuggcuucaucgcugggcugguggcccucgcccugugcgucuuuuucauucuguguugcaccggauguggcacaaauugcauggggaaacuuaaguuuaacagaugcugugaccgcuacgaagaguaugaucuggagccccauaaggugcacguucacuga

SEQ ID NO: 1006 - RNA, 4062 nt, Artificial Sequence
  derived and/or modified CDS sequence (opt5) from MERS-CoV__ALA49649__S
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccuaaaaagcucuuuguugcuaauuauucccaagacgugaaacaguucgccaacggauuugucgugcgcauuggcgccgcugccaauucuacgggcaccguuaucauuagccccuccacaagcgcuaccaucagaaagauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaagaauacuucaaccuucgcaauuguaccuuuauguauaccuacaacauuacagaggaugaaauccuggagugguucggcaucacgcagaccgcccagggggugcaccucuuuuccucuagauauguggaccuguacggaggcaauauguuccaauuugcgacacuuccugucuacgacaccauuaaguauuacagcaucauuccccacuccauccggagcauucagucugaucgcaaagccugggcugccuucuauguuuacaagcugcagccgcucacauuucugcuggacuucuccguggauggguauaucagacgggcuaucgacugcggauuuaacgaucucagccagcugcauuguucuuacgagagcuucgacguggaauccggcgucuauucugugagcuccuuugaggccauuccuagcgggucuguuguggaacaagccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccagaucucccccgcugcgauugccucuaauuguuauagcucccugauccuggauuacuucucuuauccucucagcaugaaguccgaccugagcgucucuuccgcuggcccgauuagccaauuuaacuacaagcagucuuucuccaauccuaccugccuuauccuggccacagugccccacaaccucaccacaaucacgaagccccugaaauauagcuacauuaauaagugcucuagacuucugagcgaugaccggaccgaagucccucagcucgugaacgccaaucaguauucccccuguguuagcaucgugccgucuacagucugggaggacggggauuacuaccgcaaacaacuguccccucuggaaggaggcggguggcucguggcuagcggauccaccguugccaugacagagcagcugcagaugggcuuugggauuaccgugcaguauggcacggacaccaacucugucugccccaaacuugaguucgcgaaugauacaaagaucgcuagccaacugggaaacuguguggaauacucccucuauggcgugucugggagaggaguuuuucagaauugcaccgccgucggcgugcggcagcagagauucguguacgacgccuaucauaaccuggucggguacuauagcgaugacggaaacuacuacugucugcgcgcuugcguguccguuccugugucugucauuuaugauaaggagacaaagacccacgccacgcuuuuuggcagcguggcuugugaacacaucuccagcacaaugucucaauacucccggagcaccagaucuaugcucaaacgccgggacuccacauaugggccccugcagaccccuguuggcugcgugcugggacucgucaauagcucucuguucguggaggauuguaaacuuccccugggccagucccucugcgcccugccggacaccccuagcacacugacgcccagauccguucgcagcgugcccggggaaaugcggcuugcgucuauugccuuuaaccauccuauccaggucgaucaacucaauagcuccuacuucaagcugucuaucccgaccaacuuuagcuucggagugacacaggaguauauucagaccacaauccaaaaggugaccgucgacuguaaacaguacguuugcaauggcuuccagaagugcgaacagcugcucagagaguaugggcaauuuuguuccaagauuaaccaggcucugcacggagccaaucuucgccaggaugacucugugcggaaccuguucgcuagcgugaaauccucucagagcucccccaucauuccuggcuuugggggcgacuucaaucucacgcugcuggagcccgucagcaucucuacaggauccagaagcgcccgcucugcgaucgaagaucuucucuuugacaaggugaccauugccgauccuggcuacaugcaaggguacgacgauugcaugcagcagggacccgcuuccgcccgggaccugaucugugcucaguauguugccggcuacaaagugcugccuccccucauggaugucaacauggaggccgcuuauaccagcucccugcuugggucuauugcgggagugggcuggacagccgggcugagcuccuucgcugccaucccguuugcccaaagcauuuucuacagacucaauggcguuggaaucacccaacaggugcugucugaaaaccagaagcugaucgcuaauaaauuuaaccaggcccuuggcgcgaugcagacaggguucacgaccacaaaugaggcuuuucggaagguccaggacgccgugaacaacaaugcccaagcucucuccaagcuggccagcgaacugucuaacaccuucggagcgauuagcgcuuccaucggcgauauuauccagcgccucgacguucuggagcaggaugcccagauugacagacuuaucaaugggcggcugacaacccucaacgccuucguggcucaacagcuggucagaucugagagcgccgcucuguccgcccagcuugcgaaagauaaggugaaugaaugcgugaaagcccagucuaagcgcagcggauuuuguggccaaggcacgcauaucgucuccuucguugugaacgcuccuaaugggcuguauuuuaugcacgugggauacuaucccagcaaccauauugaggucgugucugccuacggccucugcgacgcugccaauccuaccaacuguaucgcccccguuaauggguacuucauuaaaacaaacaauacccggaucguggacgaaugguccuauacaggaagcuccuuuuacgcuccggagccuauuaccucucugaacacaaaguaugucgcgccccaggugaccuaccagaauaucagcacgaaccucccuccuccccugcuuuccaacucuacaggcauugauuuccaggacgagcuggaugaauuuuucaagaauguuagcaccuccauccccaacuuugggagccucacccaaaucaauacaacccugcuggaccuuacguaugagaugcugucucuccaacagguggucaaagcccugaacgaauccuacauugaucucaaggagcugggaaauuauacauacuacaacaaauggccgugguauaucuggcuuggcuucauugcuggccugguggcccucgcccugugcgucuuuuucauccuguguugcaccggguguggaacaaauugcaugggcaaacuuaagugcaacagauguugcgaccgcuacgaagaguaugaucuggagccccacaaggugcacguucauuga

SEQ ID NO: 1007 - RNA, 4062 nt, Artificial Sequence
  derived and/or modified CDS sequence (opt5) from MERS-CoV__ALA49660__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaauucuacccugccuuuaugcuggggucuuccgugggaaacuucagcgauggcaagauggggcgguuuuucaaucauacacuuguccugcucccggacggauguggcacccugcugcgcgcguuuuacugcauucucgagcccagaucugggaaccacuguccugccggaaauuccuauacgagcuucgcuacauaccauacccccgccacagauugcucugacggcaacuauaaucggaacgcuucccugaauagcuucaaggaauacuuuaaccuucgcaauuguaccuucauguauaccuacaacaucacagaggaugaaauucuggagugguuuggcaucacgcagaccgcccaaggggugcaccucuucuccucuagauauguggaccuguacggaggcaauauguuucaguucgcgacacuuccugucuacgacaccaucaaauauuacagcauuaucccccacuccauucggagcauccagucugaucgcaaggccugggcugccuuuuauguuuacaaacugcagccgcucacauuccugcuggacuuuuccguggauggguauauuagacgggcuaucgacugcggauucaacgaucucagccaacugcauuguucuuacgagagcuuugacguggaauccggcgucuauucugugagcuccuucgaggccaagccuagcgggucuguuguggaacaggccgagggagucgagugcgauuuuagcccccuucuguccggcaccccuccccagguguacaacuucaaacgccucguuuucacgaauuguaacuacaaucugacaaaacuucugucucucuuuuccgugaacgacuuuaccugcagccaaaucucccccgcugcgauugccucuaauuguuauagcucccugauccuggauuacuuuucuuauccucucagcaugaaguccgaccugagcgucucuuccgcuggcccgauuagccaguucaacuacaagcagucuuuuuccaauccuaccugccuuauccuggccacagugccccacaaccucaccacaauuacgaagccccugaaauauagcuacaucaauaagugcucuagacuucugagcgaugaccggaccgaagucccucagcucgugaacgccaaucaauauucccccuguguuagcaucgugccgucuacagucugggaggacggggauuacuaccgcaaacagcuguccccucuggaaggaggcggguggcucguggcuagcggauccaccguugccaugacagagcagcugcagaugggcuucgggauuaccgugcaauauggcacggacaccaacucugucugccccaaacuugaauuugcgaaugauacaaagaucgcuagccagcugggaaacuguguggaguacucccucuauggcgugucugggagaggaguuuuccagaauugcaccgccgucggcgugcggcagcaaagauuuguguacgacgccuaucagaaccuggucggguacuauagcgaugacggaaacuacuacugucugcgcgcuugcguguccguuccugugucugucauuuaugauaaggagacaaagacccaugccacgcuuuucggcagcguggcuugugaacacaucuccagcacaaugucucaguacucccggagcaccagaucuaugcucaaacgccgggacuccacauaugggccccugcagaccccuguuggcugcgugcugggacucgucaauagcucucuguuuguggaggauuguaaacuuccccugggccaaucccucugcgcccugccggacaccccuagcacacugacgcccagauccguucgcagcgugcccggggaaaugcggcuugcgucuauugccuucaaccacccuauccaggucgaucagcucaauagcuccuacuuuaagcugucuauuccgaccaacuucagcuucggagugacacaagaguauauccagaccacaauccagaaggugaccgucgacuguaaacaguacguuugcaauggcuuucaaaagugcgaacagcugcucagagaguaugggcaguucuguuccaagauuaaccaggcucugcauggagccaaucuucgccaagaugacucugugcggaaccuguuugcuagcgugaaauccucucagagcucccccaucauuccuggcuucgggggcgacuuuaaucucacgcugcuggagcccgucagcaucucuacaggauccagaagcgcccgcucugcgauugaagaucuucucuucgacaaggugaccaucgccgauccuggcuacaugcagggguacgacgauugcaugcagcaaggacccgcuuccgcccgggaccugaucugugcucaguauguugccggcuacaaagugcugccuccccucauggaugucaacauggaggccgcuuauaccagcucccugcuugggucuauugcgggagugggcuggacagccgggcugagcuccuuugcugccaucccguucgcccagagcauuuucuacagacucaauggcguuggaaucacccaacaggugcugucugacaaccagaagcugauugcuaauaaauucaaccaggcccuuggcgcgaugcaaacaggguuuacgaccacaaaugaggcuuuccggaagguccaggaugccgugaacaacaaugcccaggcucucuccaagcuggccagcgaacugucuaacaccuucggagcgaucagcgcuuccaucggcgacauuauccagcgccucgauguucuggaacaagacgcccagauugauagacuuaucaaugggcggcugacaacccucaacgccuuuguggcucagcagcuggucagaucugagagcgccgcucuguccgcccaacuugcgaaagacaaggugaaugagugcgugaaagcccagucuaagcgcagcggauucuguggccagggcacgcacauugucuccuuuguugugaacgcuccuaaugggcuguauuucaugcaugugggauacuaucccagcaaccacaucgaagucgugucugccuacggccucugcgacgcugccaauccuaccaacuguaucgcccccguuaauggguacuuuauuaaaacaaacaauacccggaucguggaugagugguccuauacaggaagcuccuucuacgcuccggaaccuauuaccucucugaacacaaaguaugucgcgccccaggugaccuaccaaaauaucagcacgaaccucccuccuccccugcuuuccaacucuacaggcauugacuuucaggaugagcuggacgaguucuuuaagaauguuagcaccuccauccccaacuucgggagccucacccagauuaauacaacccugcuggaucuuacguaugaaaugcugucucuccaacagguggucaaagcccugaacgaguccuacaucgaccucaaggaacugggaaauuauacauacuacaacaaauggccgugguauaucuggcuuggcuuuauugcuggccugguggcccucgcccugugcgucuucuuuauccuguguugcaccggguguggaacaaauugcaugggcaaacuuaagugcaacagauguugcgaucgcuacgaggaauaugaccuggagccccauaaggugcacguucacuga

SEQ ID NO: 1008 - RNA, 4062 nt, Artificial Sequence
  derived and/or modified CDS sequence (opt5) from MERS-CoV__ALA49671__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacaaacugcucugauggcaauuauaaccggaaugcuucccugaacagcuucaaggaauacuucaaucuucgcaacuguaccuuuauguauaccuacaauauuacagaggacgaaauccuggagugguucggcaucacgcagaccgcccaaggggugcaccucuuuuccucuagauauguggaucuguacggaggcaacauguuccaguuugcgacacuuccugucuacgacaccauuaaauauuacagcaucauuccccacuccauccggagcauucagucugaccgcaaggccugggcugccuucuauguuuacaaacugcagccgcucacauuucugcuggauuucuccguggacggguauaucagacgggcuaucgauugcggauuuaacgaccucagccaacugcauuguucuuacgagagcuucgauguggaauccggcgucuauucugugagcuccuuugaggccaagccuagcgggucuguuguggaacaggccgagggagucgagugcgacuucagcccccuucuguccggcaccccuccccagguguacaauuuuaaacgccucguuuucacgaacuguaauuacaaccugacaaaacuucugucucucuucuccgugaaugauuuuaccugcagccaaauuucccccgcugcgaucgccucuaacuguuauagcucccugauucuggacuacuucucuuauccucucagcaugaaguccgaucugagcgucucuuccgcuggcccgaucagccaguuuaauuacaagcagucuuucuccaacccuaccugccuuauucuggccacagugccccacaaucucaccacaaucacgaagccccugaaauauagcuacaucaacaagugcucuagacuucugagcgacgaucggaccgaagucccucagcucgugaaugccaaccaauauucccccuguguuagcauugugccgucuacagucugggaggacggggacuacuaccgcaaacagcuguccccucuggaaggaggcggguggcucguggcuagcggauccaccguugccaugacagagcagcugcagaugggcuuugggaucaccgugcaauauggcacggauaccaauucugucugccccaaacuugaguucgcgaacgacacaaagauugcuagccagcugggaaauuguguggaauacucccucuauggcgugucugggagaggaguuuuucagaacugcaccgccgucggcgugcggcagcaaagauucguguacgaugccuaucagaaccuggucggguacuauagcgacgauggaaauuacuacugucugcgcgcuugcguguccguuccugugucugucaucuaugacaaggagacaaagacccaugccacgcuuuuuggcagcguggcuugugaacacauuuccagcacaaugucucaguacucccggagcaccagaucuaugcucaaacgccgggauuccacauaugggccccugcagaccccuguuggcugcgugcugggacucgucaacagcucucuguucguggaggacuguaaacuuccccugggccaaucccucugcgcccugccggauaccccuagcacacugacgcccagauccguucgcagcgugcccggggaaaugcggcuugcgucuaucgccuuuaaucacccuauucaggucgaccagcucaacagcuccuacuucaagcugucuaucccgaccaauuuuagcuucggagugacacaagaguauauccagaccacaauucagaaggugaccgucgauuguaaacaguacguuugcaacggcuuccaaaagugcgaacagcugcucagagaguaugggcaguuuuguuccaagaucaaucaggcucugcauggagccaaccuucgccaagacgauucugugcggaaucuguucgcuagcgugaaauccucucagagcucccccauuaucccuggcuuugggggcgacuucaaccucacgcugcuggagcccgucagcauuucuacaggauccagaagcgcccgcucugcgaucgaagaccuucucuuugauaaggugaccaucgccgacccuggcuacaugcagggguacgaugacugcaugcagcaaggacccgcuuccgcccgggaucugauuugugcucaguauguugccggcuacaaagugcugccuccccucauggacgucaauauggaggccgcuuauaccagcucccugcuugggucuaucgcgggagugggcuggacagccgggcugagcuccuucgcugccauuccguuugcccagagcaucuucuacagacucaacggcguuggaauuacccaacaggugcugucugauaaucagaagcugaucgcuaacaaauuuaaucaggcccuuggcgcgaugcaaacaggguucacgaccacaaacgaggcuuuucggaagguccaggacgccgugaacaauaacgcccaggcucucuccaagcuggccagcgaacugucuaauaccuucggagcgaucagcgcuuccauuggcgauaucauucagcgccucgacguucuggaacaagaugcccagaucgacagacuuauuaacgggcggcugacaacccucaaugccuucguggcucagcagcuggucagaucugagagcgccgcucuguccgcccaacuugcgaaagauaaggugaacgagugcgugaaagcccagucuaagcgcagcggauuuuguggccagggcacgcacaucgucuccuucguugugaaugcuccuaacgggcuguauuuuaugcaugugggauacuaucccagcaaucacaucgaagucgugucugccuacggccucugcgacgcugccaacccuaccaauuguauugcccccguuaacggguacuucaucaaaacaaauaacacccggauuguggacgagugguccuauacaggaagcuccuuuuacgcuccggaaccuaucaccucucugaauacaaaguaugucgcgccccaggugaccuaccaaaacauuagcacgaaccucccuccuccccugcuuuccaauucuacaggcaucgauuuccaggacgagcuggaugaguuuuucaagaacguuagcaccuccauucccaauuuugggagccucacccagaucaacacaacccugcuggaccuuacguaugaaaugcugucucuccaacagguggucaaagcccugaaugaguccuacaucgaucucaaggaacugggaaacuauacauacuacaauaaauggccgugguauauuuggcuuggcuucaucgcuggccugguggcccucgcccugugcgucuuuuucauucuguguugcaccggguguggaacaaacugcaugggcaaacuuaagugcaauagauguugcgaccgcuacgaggaauaugaucuggagccccauaaggugcacguucacuga

SEQ ID NO: 1009 - RNA, 4062 nt, Artificial Sequence
  derived and/or modified CDS sequence (opt5) from MERS-CoV__ALA49682__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauacccggauuguggacgaaugguccuauacaggaagcuccuuuuacgcuccggagccuaucaccucucugaacacaaaguaugucgcgccccaggugaccuaccaaaauauuagcacgaaccucccuccuccccugcuuuccaacucuacaggcaucgauuuccaggacgagcuggaugaauuuuucaagaauguuagcaccuccauucccaacuuugggagccucacccagaucaauacaacccugcuggaccuuacguaugagaugcugucucuccaacagguggucaaagcccugaacgaauccuacaucgaucucaaggagcugggaaauuauacauacuacaacaaauggccgugguauauuuggcuuggcuucaucgcuggccugguggcccucgcccugugcgucuuuuucauucuguguugcaccggguguggaacaaauugcaugggcaaacuuaagugcaacagauguugcgaccgcuacgaagaguaugaucuggagccccauaaggugcacguucacuga

SEQ ID NO: 1010 - RNA, 4062 nt, Artificial Sequence
  derived and/or modified CDS sequence (opt5) from MERS-CoV__ALA49803__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagaucgcuauguguacagcgccggccacgcgaccgggacaaccccucaaaaacucuuuguugcuaauuauucccaggacgugaagcaguucgccaacggauuugucgugagaauuggcgccgcugccaauucuacgggcaccguuaucauuagccccuccacaagcgcuaccauccggaaaauuuacccugccuucaugcuggggucuuccgugggaaacuuuagcgauggcaagauggggcgcuucuuuaaucauacacuuguccugcucccggacggauguggcacccugcugagagcguucuacugcauccucgagccccggucugggaaccacuguccugccggaaauuccuauacgagcuuugcuacauaccauacccccucuacagauugcuccgacggcaacuauaaucgcaacgccagccuuaauuccuucaaggaauacuucaaccuuagaaauuguaccuuuauguauaccuacaacauuacagaggaugaaauccuggagugguucggcaucacgcagaccgcucaaggggugcaccucuuuucuagccgguauguggaccuguacggaggcaauauguuccaguuugccacacuuccugucuacgacaccauuaaauauuacuccaucauuccccacagcauccgcucuauucaguccgauagaaaggcgugggccgcuuucuauguuuacaaacugcagccgcucacauuucugcuggacuucagcguggauggguauauccggcgcgccaucgacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcaccccuccccagguguacaacuuuaaaagacucguuuucacgaauuguaacuacaaucugacaaagcugcugucccucuucagcgugaacgacuuuaccugcucccaaauuucucccgccgcuaucgcgagcaauuguuauuccucucugauucuggauuacuucagcuauccucucuccaugaaaagcgaccugucugucuccagcgccggcccgaucucucaguuuaacuacaagcaguccuucagcaauccuaccugccuuauucuggcuacagugccccacaaccucaccacaaucacgaagccccugaaauauucuuacaucaauaagugcagccggcuucuguccgaugaccgcaccgaagucccucagcucgugaacgccaaucaauauagccccuguguuucuauugugccguccacagucugggaggacggggauuacuacagaaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggcggggaguuuuucagaauugcaccgcugucggcgugagacagcaacgcuucguguacgacgccuaucagaaccuggucggguacuauuccgaugacggaaacuacuacugucugcgggccugcgugucuguuccugugagcgucaucuaugauaaggagacaaagacccaugcuacgcuuuuuggcuccguggccugugaacacauuagcucuacaaugucccaguacagcagaucuacccgcuccaugcucaaacggagagacagcacauaugggccccugcagaccccuguuggcugcgugcugggacucgucaauucuucccuguucguggaggauuguaaacuuccccugggccaaagccucugcgcucugccggacaccccuuccacacugacgccccgcagcguucggucugugcccggggaaaugagacuugccagcaucgcguuuaaccacccuauucaggucgaucagcucaauuccucuuacuucaagcugagcaucccgaccaacuuuuccuucggagugacacaagaguauauccagaccacaauucagaaggugaccgucgacuguaaacaguacguuugcaauggcuuccaaaagugcgaacagcugcuccgcgaguaugggcaguuuuguucuaagaucaaccaggcccugcauggagcuaaucuucggcaagaugacagcgugagaaaccuguucgccuccgugaaaucuagccaguccagccccauuaucccuggcuuugggggcgacuucaaucucacgcugcuggagcccgucucuauuuccacaggaagccgcucugcucgguccgccaucgaagaucuucucuuugacaaggugaccaucgcggauccuggcuacaugcagggguacgacgauugcaugcagcaaggacccgccagcgcuagagaccugauuugugcccaguauguugcuggcuacaaagugcugccuccccucauggaugucaacauggaggccgccuauaccuccucucugcuugggagcaucgcuggagugggcuggacagcggggcuguccagcuucgccgcuauuccguuugcccagucuaucuucuaccggcucaauggcguuggaauuacccaacaggugcuguccgaaaaccagaagcugaucgccaauaaauuuaaccaggcucuuggcgccaugcaaacaggguucacgaccacaaaugaggcguuucgcaagguccaggacgcugugaacaacaaugcccaggcccucagcaagcuggcuucugaacugagcaacaccuucggagccaucuccgcgucuauuggcgauaucauucagagacucgacguucuggagcaagaugcucagaucgaccggcuuauuaaugggagacugacaacccucaacgccuucguggcccagcagcugguccgcagcgaguccgcugcccugucugcucaacuugccaaagauaaggugaaugaaugcgugaaagcgcagagcaagcgguccggauuuuguggccagggcacgcacaucgucagcuucguugugaacgccccuaaugggcuguauuuuaugcaugugggauacuaucccucuaaccacaucgaggucguguccgcuuacggccucugcgacgccgcuaauccuaccaacuguauugcccccguuaauggguacuucaucaaaacaaacaauaccagaguggucgacgaauggagcuauacaggauccucuuuuuacgccccggagccuauuaccagccugaacacaaaguauguggcuccccagguuaccuaccaaaauaucuccacgaaccucccuccuccccugcuuucuaacagcacaggcauugauuuccaggacgagcuggaugaauuuuucaagaauguguccaccagcauccccaacuuugggucucucacccagauuaauacaacccugcuggaccuuacguaugagaugcugucccuccaacaggucgugaaagcgcugaacgaaagcuacaucgaucucaaggagcugggaaauuauacauacuacaacaaauggccgugguauaucuggcuuggcuucauugccggccuggucgcucucgcccugugcguguuuuucauccuguguugcaccggguguggaacaaauugcaugggcaaacuuaagugcaaccgcuguugcgacagauacgaagaguaugaucuggagccccauaagguucacgugcacuga

SEQ ID NO: 1011 - RNA, 4062 nt, Artificial Sequence
  derived and/or modified CDS sequence (opt5) from MERS-CoV__ALA49836__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuccagcaauccuaccugccuuauucuggccacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggcuuccggaucuaccguugccaugacagagcagcugcagaugggcuucgggaucaccgugcaauauggcacggacaccaacagcgucugccccaaacuugaauuugcgaaugauacaaagauugcuucccagcugggaaacuguguggaguacucucucuauggcgugagcgggagaggaguuuuccagaauugcaccgccgucggcgugcggcagcaaagauuuguguacgacgccuaucagaaccuggucggguacuauuccgaugacggaaacuacuacugucugcgcgcuugcgugucuguuccugugagcgucaucuaugauaaggagacaaagacccaugccacgcuuuucggcuccguggcuugugaacacauuagcucuacaaugucccaguacagccggucuaccagauccaugcucaaacgccgggacagcacauaugggccccugcagaccccuguuggcugcgugcugggacucgucaauucuucccuguuuguggaggauuguaaacuuccccugggccaaagccucugcgcccugccggacaccccuuccacacugacgcccagaagcguucgcucugugcccggggaaaugcggcuugcgagcaucgccuucaaccacccuauucaggucgaucagcucaauuccucuuacuuuaagcugagcaucccgaccaacuucuccuuuggagugacacaagaguauauccagaccacaauucagaaggugaccgucgacuguaaacaguacguuugcaauggcuuccaaaagugcgaacagcugcucagagaguaugggcaguucuguucuaagaucaaccaggcucugcauggagccaaucuucgccaagaugacagcgugcggaaccuguuugcuuccgugaaaucuagccaguccagccccauuaucccuggcuucgggggcgacuuuaaucucacgcugcuggagcccgucucuauuuccacaggaagcagaucugcccgcuccgcgaucgaagaucuucucuucgacaaggugaccaucgccgauccuggcuacaugcagggguacgacgauugcaugcagcaaggacccgcuagcgcccgggaccugauuugugcucaguauguugccggcuacaaagugcugccuccccucauggaugucaacauggaggccgcuuauaccuccucucugcuugggagcaucgcgggagugggcuggacagccgggcuguccagcuuugcugccauuccguucgcccagucuaucuuuuacagacucaauggcguuggaauuacccaacaggugcuguccgaaaaccagaagcugaucgcuaauaaauucaaccaggcccuuggcgcgaugcaaacaggguuuacgaccacaaaugaggcuuuccggaagguccaggacgccgugaacaacaaugcccaggcucucagcaagcuggccucugaacugagcaacaccuuuggagcgaucuccgcuucuauuggcgauaucauucagcgccucgacguucuggagcaagaugcccagaucgacagacuuauuaaugggcggcugacaacccucaacgccuucguggcucagcagcuggucagaagcgaguccgccgcucugucugcccaacuugcgaaagauaaggugaaugaaugcgugaaagcccagagcaagcgcuccggauucuguggccagggcacgcacaucgucagcuuuguugugaacgcuccuaaugggcuguauuucaugcaugugggauacuaucccucuaaccacaucgaggucguguccgccuacggccucugcgacgcugccaauccuaccaacuguauugcccccguuaauggguacuuuaucaaaacaaacaauacccggauuguggacgaauggagcuauacaggauccucuuucuacgcuccggagccuaucaccagccugaacacaaaguaugucgcgccccaggugaccuaccaaaauauuuccacgaaccucccuccuccccugcuuggcaacucuacagggaucgauuuucaggacgagcuggaugaguucuuuaagaauguuagcaccuccauucccaacuucggaagccucacccagaucaauacaacccugcuggaccuuacguaugaaaugcugucucuccaacagguggucaaagcccugaacgaauccuacaucgaucucaaggagcugggcaauuauacauacuacaacaaauggccgugguauauuuggcuuggcuuuaucgcugggcugguggcccucgcccugugcgucuucuuuauucuguguugcaccggauguggcacaaauugcauggggaaacuuaagugcaacagauguugcgaccgcuacgaagaguaugaucuggagccccauaaggugcacguucacuga

SEQ ID NO: 1012 - RNA, 4062 nt, Artificial Sequence
  derived and/or modified CDS sequence (opt5) from MERS-CoV__ALA49957__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccagauccguucgcagcgugcccggggaaaugcggcuugcgucuaucgccuuuaaccacccuauucaggucgaucagcucaauagcuccuacuucaagcugucuaucccgaccaacuuuagcuucggagugacacaagaguauauccagaccacaauucagaaggugaccgucgacuguaaacaguacguuugcaauggcuuccaaaagugcgaacagcugcucagagaguaugggcaguuuuguuccaagaucaaccaggcucugcauggagccaaucuucgccaagaugacucugugcggaaccuguucgcuagcgugaaauccucucagagcucccccauuaucccuggcuuugggggcgacuucaaucucacgcugcuggagcccgucagcauuucuacaggauccagaagcgcccgcucugcgaucgaagaucuucucuuugacaaggugaccaucgccgauccuggcuacaugcagggguacgacgauugcaugcagcaaggacccgcuuccgcccgggaccugauuugugcucaguauguugccggcuacaaagugcugccuccccucauggaugucaacauggaggccgcuuauaccagcucccugcuugggucuaucgcgggagugggcuggacagccgggcugagcuccuucgcugccauuccguuugcccagagcaucuucuacagacucaauggcguuggaauuacccaacaggugcugucugaaaaccagaagcugaucgcuaauaaauuuaaccaggcccuuggcgcgaugcaaacaggguucacgaccacaaaugaggcuuuucggaagguccaggacgccgugaacaacaaugcccaggcucucuccaagcuggccagcgaacugucuaacaccuucggagcgaucagcgcuuccauuggcgauaucauucagcgccucgacguucuggagcaagaugcccagaucgacagacuuauuaaugggcggcugacaacccucaacgccuucguggcucagcagcuggucagaucugagagcgccgcucuguccgcccaacuugcgaaagauaaggugaaugaaugcgugaaagcccagucuaagcgcagcggauuuuguggccagggcacgcacaucgucuccuucguugugaacgcuccuaaugggcuguauuuuaugcaugugggauacuaucccagcaaccacaucgaggucgugucugccuacggccucugcgacgcugccaauccuaccaacuguauugcccccguuaauggguacuucaucaaaacaaacaauaccacaauuguggacgaaugguccuauaccggaagcuccuuuuacgcuccggagccuaucacaucucugaacaccaaguaugucgcgccccaggugacguaccaaaauauuagcacaaaccucccuccuccccugcuuggcaacuccaccgggaucgauuuccaggacgagcuggaugaauuuuucaagaauguuucuaccagcauucccaacuuuggaucccucacacagaucaauaccacgcugcuggaccuuacauaugagaugcugagccuccaacagguggucaaagcccugaacgaaucuuacaucgaucucaaggagcugggcaauuauaccuacuacaacaaauggccgugguauauuuggcuuggcuucaucgcugggcugguggcccucgcccugugcgucuuuuucauucuguguugcacaggauguggcaccaauugcauggggaaacuuaagugcaaccgguguugcgacagauacgaagaguaugaucuggagccccauaaggugcacguucacuga

SEQ ID NO: 1013 - RNA, 4062 nt, Artificial Sequence
  derived and/or modified CDS sequence (opt5) from MERS-CoV__ALA50067__S
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccagcggcccgaucucucaguuuaacuacaagcaguccuucagcaauccuaccugccuuauucuggcuacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggagaggaguuuuucagaauugcaccgcugucggcgugcggcagcaaagauucguguacgacgccuaucagaaccuggucggguacuauuccgaugacggaaacuacuacugucugcgcgccugcgugucuguuccugugagcgucaucuaugauaaggagacaaagacccaugcuacgcuuuuuggcuccguggccugugaacacauuagcucuacaaugucccaguacagccggucuaccagauccaugcucaaacgccgggacagcacauaugggccccugcagaccccuguuggcugcgugcugggacucgucaauucuucccuguucguggaggauuguaaacuuccccugggccaaagccucugcgcucugccggacaccccuuccacacugacgcccagaagcguucgcucugugcccggggaaaugcggcuugccagcaucgcguuuaaccacccuauucaggucgaucagcucaauuccucuuacuucaagcugagcaucccgaccaacuuuuccuucggagugacacaagaguauauccagaccacaauucagaaggugaccgucgacuguaaacaguacguuugcaauggcuuccaaaagugcgaacagcugcucagagaguaugggcaguuuuguucuaagaucaaccaggcccugcauggagcuaaucuucgccaagaugacagcgugcggaaccuguucgccuccgugaaaucuagccaguccagccccauuaucccuggcuuugggggcgacuucaaucucacgcugcuggagcccgucucuauuuccacaggaagcagaucugcucgcuccgccaucgaagaucuucucuuugacaaggugaccaucgcggauccuggcuacaugcagggguacgacgauugcaugcagcaaggacccgccagcgcucgggaccugauuugugcccaguauguugcuggcuacaaagugcugccuccccucauggaugucaacauggaggccgccuauaccuccucucugcuugggagcaucgcuggagugggcuggacagcggggcuguccagcuucgccgcuauuccguuugcccagucuaucuucuacagacucaauggcguuggaauuacccaacaggugcuguccgaaaaccagaagcugaucgccaauaaauuuaaccaggcucuuggcgccaugcaaacaggguucacgaccacaaaugaggcguuucggaagguccaggacgcugugaacaacaaugcccaggcccucagcaagcuggcuucugaacugagcaacaccuucggagccaucuccgcgucuauuggcgauaucauucagcgccucgacguucuggagcaagaugcucagaucgacagacuuauuaaugggcggcugacaacccucaacgccuucguggcccagcagcuggucagaagcgaguccgcugcccugucugcucaacuugccaaagauaaggugaaugaaugcgugaaagcgcagagcaagcgcuccggauuuuguggccagggcacgcacaucgucagcuucguugugaacgccccuaaugggcuguauuuuaugcaugugggauacuaucccucuaaccacaucgaggucguguccgcuuacggccucugcgacgccgcuaauccuaccaacuguauugcccccguuaauggguacuucaucaaaacaaacaauacccggauuguggacgaauggagcuauacaggauccucuuuuuacgccccggagccuaucaccagccugaacacaaaguaugucgcuccccaggugaccuaccaaaauauuuccacgaaccucccuccuccccugcuuucuaacagcacaggcaucgauuuccaggacgagcuggaugaauuuuucaagaauguuuccaccagcauucccaacuuugggucucucacccagaucaauacaacccugcuggaccuuacguaugagaugcugucccuccaacagguggucaaagcgcugaacgaaagcuacaucgaucucaaggagcugggaaauuauacauacuacaacaaauggccgugguauauuuggcuuggcuucaucgccggccugguggcucucgcccugugcgucuuuuucauucuguguugcaccggguguggaacaaauugcaugggcaaacuuaagugcaacagauguugcgaccgcuacgaagaguaugaucuggagccccauaaggugcacguucacuga

SEQ ID NO: 1014 - RNA, 249 nt, Artificial Sequence
  derived and/or modified CDS sequence (opt5) from MERS-CoV__AGH58723__E
augcugcccuucgugcaggagagaaucggccucuuuauugucaacuucuuuaucuucaccguugugugcgccauuacacugcuuguguguauggcuuuucugacggccacccggcucugcguccaauguaugacaggguucaauacccugcuugugcagccugcgcuguaccucuauaacacaggacgcagcguuuacgugaaguuucaggacuccaaaccgccccugccucccgaugaaugggucuga

SEQ ID NO: 1015 - RNA, 249 nt, Artificial Sequence
  derived and/or modified CDS sequence (opt5) from MERS-CoV__AGV08472__E
augcugcccuucgugcaggagagagucggccucuuuaucguuaacuucuuuauuuucaccguggugugcgccaucacacugcuugucuguauggcuuuucugacggccacccggcucugcgugcaauguaugacaggguucaauacccugcuuguucagccugcgcuguaccucuauaacacaggacgcagcguguacgucaaguuucaggacuccaaaccgccccugccucccgaugaauggguguga

SEQ ID NO: 1016 - RNA, 249 nt, Artificial Sequence
  derived and/or modified CDS sequence (opt5) from MERS-CoV__AGV08540__E
augcugcccuucgugcaggagagaaucggccucuuuauugucaaguucuuuaucuucaccguugugugcgccauuacacugcuuguguguauggcuuuucugacggccacccggcucugcguccaauguaugacaggguucaacacccugcuugugcagccugcgcuguaccucuauaauacaggacgcagcguuuacgugaaauuucaggacuccaagccgccccugccucccgaugaaugggucuga

SEQ ID NO: 1017 - RNA, 249 nt, Artificial Sequence
  derived and/or modified CDS sequence (opt5) from MERS-CoV__ALX27237__E
augcugcccuucgugcaggagagaaucggccucuuuauugucaacuucuuuaucuucaccguugugugcgccauuacacugcuuguguguauggcuuuucugacggccacccggcucugcguccaauguaugacaggguucaauacccugcuugugcagccugcgcuguaccucuauaacacaggacgcagcguuuacgugaaguuucaggacuccaaaccgccccugccuucugaugaaugggucuga

SEQ ID NO: 1018 - RNA, 249 nt, Artificial Sequence
  derived and/or modified CDS sequence (opt5) from MERS-CoV__ALR69646__E
augcugcccuucgugcaggagagaaucggccucuuuauugucaacuucuuuaucuucaccguugugugcgccauuacacugcuuguguguauggcuuuucugacggccacccggcucugcguccaauguaucacaggguucaauacccugcuugugcagccugcgcuguaccucuauaacacaggacgcagcguuuacgugaaguuucaggacuccaaaccgccccugccucccgaugaaugggucuga

SEQ ID NO: 1019 - RNA, 249 nt, Artificial Sequence
  derived and/or modified CDS sequence (opt5) from MERS-CoV__ALA49346__E
augcugcccuucgugcaggagagaaucggccucuuuauugucaacuucagcaucuuuaccguugugugcgccauuacacugcuuguguguauggcuuuccugacggccacccggcucugcguccaauguaugacaggguuuaauacccugcuugugcagccugcgcuguaccucuauaacacaggacgcuccguuuacgugaaguuccaggacucuaaaccgccccugccucccgaugaaugggucuga

SEQ ID NO: 1020 - RNA, 249 nt, Artificial Sequence
  derived and/or modified CDS sequence (opt5) from MERS-CoV__ALA49390__E
augcugcccuucgugcaggagagaaucggccucuuuauugucaacuucuuuaucuucaccguugugugcgccauuacacugcuuguguguauggcuuuucugacggccacccggcucugcguccaauguaugacagggcugaauacccuucuggugcagccugcgcucuaccuguauaacacaggacgcagcguuuacgugaaguuccaggacuccaaaccgccccugccucccgaugaaugggucuga

SEQ ID NO: 1021 - RNA, 660 nt, Artificial Sequence
  derived and/or modified CDS sequence (opt5) from MERS-CoV__AFS88942__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuguguauccgauugaucucgccucucagaucauuagcgggaucgucgccgcuguguccgccaugauguggauuagcuacuuuguucagucuauccggcuguucaugcgcacaggauccugguggagcuuuaaccccgaaaccaauugccugcucaacgugccuuucggcgggacaaccgucgugagaccccugguugaggacucuacauccgugaccgcugucgugacgaauggacaccuuaagauggccggcaugcauuuuggggcgugugauuaugaccggcugccuaacgaagugaccgucgccaaacccaauguucucauugcucugaagauggugaaacgccaaagcuacggaacaaacucuggcguggccaucuaucacagauacaaggcuggcaauuaccgguccccuccgaucaccgccgauauugagcuugcgcugcuccgcgccuga

SEQ ID NO: 1022 - RNA, 660 nt, Artificial Sequence
  derived and/or modified CDS sequence (opt5) from MERS-CoV__AGH58718__M
augagcaacaugacccagcugacagaggcccaaaucauugcugugaucaaggacuggaauuucgccuggucccucauuuuucugcuuaucacgauuguccugcaguacggcuaucccucuagaagcaugaccguuuacguguucaaaauguuugugcucuggcugcuuuggccuuccucuauggcgcugagcaucuucuccacagucuauccgaucgaucucgcuucucagauuaucagcgggauuguggccgccguuuccgcuaugauguggaucagcuacuuugugcagucuauucggcuguucaugcgcaccggauccugguggagcuuuaaccccgaaacaaauugccugcucaacgucccuuucggcgggaccacagugguuagaccccugguggaggacucuaccuccgucacggccguggugaccaauggacaccuuaagauggcuggcaugcauuuuggggccugugauuaugaccggcugccuaacgaagucacaguugcgaaacccaaugugcucaucgcccugaagauggugaaacgccaaagcuacggaaccaacucuggcgucgcuauuuaucacagauacaaggccggcaauuaccgguccccuccgaucacagcugauaucgagcuugcccugcuccgcgcguga

SEQ ID NO: 1023 - RNA, 660 nt, Artificial Sequence
  derived and/or modified CDS sequence (opt5) from MERS-CoV__AGV08396__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaccccgaaaccaauugccugcucaacguuccuuucggcgggacaaccguggucagaccccugguggaggacucuacauccguuaccgcuguggucacgaauggacaccuuaagauggccggcaugcauuuuggggcgugugauuaugaccggcugccuaacgaagugaccguggccaaacccaauguccucaucgcucugaagaugguuaaacgccaaagcuacggaacaaacucuggcguggccaucuaucacagauacaaggcuggcaauuaccgguccccuccgauuaccgccgauaucgagcuugcgcugcuccgcgccuga

SEQ ID NO: 1024 - RNA, 660 nt, Artificial Sequence
  derived and/or modified CDS sequence (opt5) from MERS-CoV__AGV08590__M
augagcaacaugacccagcugacagaggcccaaaucauugcuaucauuaaggacuggaauuucguguggucccucaucuuucugcuuauuacgaucguccugcaguacggcuaucccucuagaagcaugaccguuuacguguucaaaauguuugugcucuggcugcuuuggccuuccucuauggcccugagcaucuucuccgcggucuauccgauugaucucgcuucucagaucauuagcgggaucguggccgccguuuccgcuaugauguggauuagcuacuuugugcagucuauccggcuguucaugcgcacaggauccugguggagcuuuaaccccgaaaccaauugccugcucaacgucccuuucggcgggacaaccgugguuagaccccugguggaggacucuacauccgucaccgccguggugacgaauggacaccuuaagauggcuggcaugcauuuuggggccugugauuaugaccggcugccuaacgaagucaccguugcgaaacccaaugugcucauugcccugaagauggugaaacgccaaagcuacggaacaaacucuggcgucgcuaucuaucacagauacaaggccggcaauuaccgguccccuccgaucaccgcugauauugagcuugcccugcuccgcgcguga

SEQ ID NO: 1025 - RNA, 660 nt, Artificial Sequence
  derived and/or modified CDS sequence (opt5) from MERS-CoV__AHI48567__M
augagcaacaugacccagcuggccgaggcucaaaucauugccaucauuaaggacuggaauuucgcguggucccucaucuuucugcuuauuacaaucgugcugcaguacggcuaucccucuagaagcaugacggucuacguuuucaaaauguuugugcucuggcugcuuuggccuuccucuauggcucugagcaucuucuccgccguguauccgauugaucucgccucucagaucauuagcgggaucgucgcugccguguccgcuaugauguggauuagcuacuuuguucagucuauccggcuguucaugcgcaccggauccugguggagcuuuaaccccgaaacaaauugccugcucaacgugccuuucggcgggaccacagucgugagaccccugguugaggacucuaccuccgugacagccgucgugaccaauggacaccuuaagauggcgggcaugcauuuuggggccugugauuaugaccggcugccuaacgaagugacggucgcuaaacccaauguucucauugcccugaagauggugaaacgccaaagcuacggaaccaacucuggcguggcuaucuaucacagauacaaggccggcaauuaccgguccccuccgaucacagcggauauugagcuugcccugcuccgcgcuuga

SEQ ID NO: 1026 - RNA, 660 nt, Artificial Sequence
  derived and/or modified CDS sequence (opt5) from MERS-CoV__AHI48589__M
augagcaacaugacccagcugacagaggcccaaaucauugcugugaucaaggacuggaauuucgccuggucccucauuuuucugcuuaucacgauuguccugcaguacggcuaucccucuagaagcaugaccguuuacguguucaaaauguuugugcucuggcugcuuuggccuuccucuauggcgcugagcaucuucuccgcuaucuauccgauugaucucgccucucagaucauuagcgggaucgucgccgcuguguccgccaugauguggauuagcuacuuuguucagucuauccggcuguucaugcgcacaggauccugguggagcuuuaaccccgaaaccaauugccugcucaacgugccuuucggcgggacaaccgucgugagaccccugguugaggacucuacauccgugaccgcugucgugacgaauggacaccuuaagauggccggcaugcauuuuggggcgugugauuaugaccggcugccuaacgaagugaccgucgccaaacccaauguucucauugcucugaagauggugaaacgccaaagcuacggaacaaacucuggcguggccaucuaucacagauacaaggcuggcaauuaccgguccccuccgaucaccgccgauauugagcuugcgcugcuccgcgccuga

SEQ ID NO: 1027 - RNA, 660 nt, Artificial Sequence
  derived and/or modified CDS sequence (opt5) from MERS-CoV__AIL23940__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaccccgaaaccaauugccugcucaacguuccuuucggcgggacaaccguggucagaccccugguggaggacucuacauccguuaccgcuguggucacgaauggacaccuuaagauggccggcaugcauuuuggggcgugugauuaugaccggcugccuaacgaagugaccguggccaaacccaaugucguuaucgcucucaagauggugaaacgccaaagcuacggaacaaacucuggcguggccaucuaucacagauacaaggcuggcaauuaccgguccccuccgauuaccgccgauaucgagcuggcgcuucugcgcgccuga

SEQ ID NO: 1028 - RNA, 660 nt, Artificial Sequence
  derived and/or modified CDS sequence (opt5) from MERS-CoV__AKM76245__M
augagcaacaucacccagcugacagaggcccaaauuaucgcuauuaucaaggacuggaauuucgccuggucccucauuuuucugcuuaucacgaucgugcugcaguacggcuaucccucuagaagcaugaccgucuacguuuucaaaauguuugugcucuggcugcuuuggccuuccucuauggcgcugagcauuuucuccgcuguguauccgaucgaucucgccucucagauuaucagcgggauugucgccgcuguguccgccaugauguggaucagcuacuuuguucagucuauucggcuguucaugcgcacaggauccugguggagcuuuaaccccgaaaccaauugccugcucaacgugccuuucggcgggacaaccgucgugagaccccugguugaggacucuacauccgugaccgcugucgugacgaauggacaccuuaagauggccggcaugcauuuuggggcgugugauuaugaccggcugccuaacgaagugaccgucgccaaacccaauguucucaucgcucugaagauggugaaacgccaaagcuacggaacaaacucuggcguggccaucuaucacagauacaaggcuggcaauuaccgguccccuccgauuaccgccgauaucgagcuugcgcugcuccgcgccuga

SEQ ID NO: 1029 - RNA, 660 nt, Artificial Sequence
  derived and/or modified CDS sequence (opt5) from MERS-CoV__ALW82726__M
augagcaacaugacccagcugacagaggcccaaaucauugcuaucauuaaggacuggcacuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaucccgaaaccaacugccugcucaauguuccuaucggcgggacaaccguggucagaccccugguggaggacucuacauccguuaccgcuguggucacgaacggacaucuuaagauggccggcaugcacuucggggcgugugauuaugaccggcugccuaaugaagugaccguggccaaacccaacguccucaucgcucugaagaugguuaaacgccaaagcuacggaacaaauucuggcguggccauuuaucauagauacaaggcuggcaacuaccgguccccuccgaucaccgccgauauugagcuugcgcugcuccgcgccuga

SEQ ID NO: 1030 - RNA, 660 nt, Artificial Sequence
  derived and/or modified CDS sequence (opt5) from MERS-CoV__ALX27238__M
augagcaacaugacccagcugacagaggcccaaaucauugcuaucauuaaggacugguccuucgccuggucucucaucuuucugcuuauuacgaucgugcugcaguacggcuaucccagcagauccaugaccgucuacguuuucaaaauguuugugcucuggcugcuuuggccuucuagcauggcgcuguccaucuucucugcuguguauccgauugaucucgccagccagaucauuuccgggaucgucgccgcugugagcgccaugauguggauuucuuacuuuguucaguccauccggcuguucaugcgcacaggaagcugguggucuuuuaaucccgaaaccaacugccugcucaaugugccuuucggcgggacaaccgucgugagaccccugguugaggacuccacaagcgugaccgcugucgugacgaacggacaccuuaagauggccggcaugcauuuuggggcgugugauuaugaccggcugccuaaugaagugaccgucgccaaacccaacguucucauugcucugaagauggugaaacgccaaucuuacggaacaaauuccggcguggccaucuaucacagauacaaggcuggcaacuaccggagcccuccgaucaccgccgauauugagcuugcgcugcuccgcgccuga

SEQ ID NO: 1031 - RNA, 660 nt, Artificial Sequence
  derived and/or modified CDS sequence (opt5) from MERS-CoV__AMQ49021__M
augagcaacaugacccagcugacagaggcccaaaucauugcuaucauuaaggacuggcacuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaucccgaaaccaacugccugcucaauguuccuaucggcgggacaaccguggucagaccccugguggaggacucuacauccguuaccgcuguggucacgaacggacaucuuaagauggccggcaugcacuucggggcgugugauuaugaccggcugagcaaugaagugaccguggccaaaccuaacguccucaucgcucugaagaugguuaaacgccaaucuuacggaacaaauuccggcguggccauuuaucauagauacaaggcuggcaacuaccggagcccucccaucaccgccgauauugagcuugcgcugcuccgcgccuga

SEQ ID NO: 1032 - RNA, 660 nt, Artificial Sequence
  derived and/or modified CDS sequence (opt5) from MERS-CoV__AJG44108__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuuuuuauccgauugaucucgccucucagaucauuagcgggaucguggccgcugucuccgccaugauguggauuagcuacuucgugcagucuauccggcuguuuaugcgcacaggauccugguggagcuucaaccccgaaaccaauugccugcucaacguuccuuuuggcgggacaaccguggucagaccccugguggaggacucuacauccguuaccgcuguggucacgaauggacaccuuaagauggccggcaugcauuucggggcgugugauuaugaccggcugccuaacgaagugaccguggccaaacccaauguccucauugcucugaagaugguuaaacgccaaagcuacggaacaaacucuggcguggccaucuaucacagauacaaggcuggcaauuaccgguccccuccgaucaccgccgauauugagcuugcgcugcuccgcgccuga

SEQ ID NO: 1033 - RNA, 660 nt, Artificial Sequence
  derived and/or modified CDS sequence (opt5) from MERS-CoV__ALA49369__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaccccgaaaccaauugccugcucaacguuccuaucggcgggacaaccguggucagaccccugguggaggacucuacauccguuaccgcuguggucacgaauggacaccuuaagauggccggcaugcauuucggggcgugugauuaugaccggcugccuaacgaagugaccguggccaaacccaauguccucaucgcucugaagaugguuaaacgccaaagcuacggaacaaacucuggcguggccauuuaucacagauacaaggcuggcaauuaccgguccccuccgaucaccgccgauauugagcuugcgcugcuccgcgccuga

SEQ ID NO: 1034 - RNA, 660 nt, Artificial Sequence
  derived and/or modified CDS sequence (opt5) from MERS-CoV__ALA49424__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugaugcggaucagcuacuuugugcagucuauucgccuguucaugagaacaggauccugguggagcuuuaaccccgaaaccaauugccugcucaacguuccuuucggcgggacaaccgugguccggccccugguggaggacucuacauccguuaccgcuguggucacgaauggacaccuuaagauggccggcaugcauuuuggggcgugugauuaugaccgccugccuaacgaagugaccguggccaaacccaauguccucaucgcucugaagaugguuaaaagacaaagcuacggaacaaacucuggcguggccaucuaucaccgguacaaggcuggcaauuaccgcuccccuccgauuaccgccgauaucgagcuugcgcugcucagagccuga

SEQ ID NO: 1035 - RNA, 660 nt, Artificial Sequence
  derived and/or modified CDS sequence (opt5) from MERS-CoV__ALA49908__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucucuagccagauuaucuccgggauuguggccgccgucagcgcuaugauguggaucucuuacuuugugcaguccauucggcuguucaugcgcacaggaagcugguggucuuuuaaccccgaaaccaauugccugcucaacguuccuuucggcgggacaaccguggucagaccccugguggaggacuccacaagcguuaccgccguggucacgaauggacaccuuaagauggcuggcaugcauuuuggggccugugauuaugaccggcugccuaacgaagugaccguggcgaaacccaauguccucaucgcccugaagaugguuaaacgccaaucuuacggaacaaacuccggcguggcuaucuaucacagauacaaggccggcaauuaccggagcccuccgauuaccgcugauaucgagcuugcccugcuccgcgcguga

SEQ ID NO: 1036 - RNA, 660 nt, Artificial Sequence
  derived and/or modified CDS sequence (opt5) from MERS-CoV__ALA49963__M
augagcaacaugacccagcugacagaggcccaaaucauugcuaucauuaaggacuggaauuucgccuggucccucaucuuucugcuuauuacgaucgugcugcaguacggcuaucccucuagaagcaugaccgucuacguuuucaaaauguuugugcucuggcugcuuuggccuuccucuauggcgcugagcaucuucuccgcuauuuauccgaucgaucucgccucucagauuaucagcgggauuguggccgcugucuccgccaugauguggaucagcuacuuugugcagucuauucggcuguucaugcgcacaggauccugguggagcuuuaaccccgaaaccaauugccugcucaacguuccuaucggcgggacaaccguggucagaccccugguggaggacucuacauccguuaccgcuguggucacgaauggacaccuuaagauggccggcaugcauuucggggcgugugauuaugaccggcugagcaacgaagugaccguggccaaaccuaauguccucaucgcucugaagaugguuaaacgccaaucuuacggaacaaacuccggcguggccauuuaucacagauacaaggcuggcaauuaccggagcccucccaucaccgccgauauugagcuugcgcugcuccgcgccuga

SEQ ID NO: 1037 - RNA, 1242 nt, Artificial Sequence
  derived and/or modified CDS sequence (opt5) from MERS-CoV__AFS88943__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucucuuuccagaaacagcucucgguccagcucucagggaucccgcagcggcaauuccacgagaggcacaucucccgggccuagcggaaucggcgcugucgggggagaucugcucuaucuggaccugcucaaccggcugcaggcccuugaauccggcaaggugaaacaaagccagcccaaggugaucaccaaaaaggaugcugccgccgcuaaaaauaagaugcgccauaagagaacaucuaccaaauccuuuaacaugguucaggcguucgggcugcggggacccggcgaccuccagggcaauuuuggggaucugcaacuuaacaagcugggaaccgaggacccuagauggccgcagauugccgaacucgcucccacagccagcgccuucaugggcaugucucaguuuaaacugacgcaccaaaauaacgaugaccaugggaauccuguguacuuccugcgcuauagcggagcuaucaagcucgaccccaaaaacccuaauuacaacaaguggcuggagcuucuggagcagaauauugaugccuacaaaaccuuucccaagaaggagaaaaagcagaaagcgccgaaggaagaauccacagaccagaugucugagccucccaaagagcaacggguccagggcagcaucacccagagaacacgcacccggccuuccgugcagcccgggccuaugauugaugugaacacggacuga

SEQ ID NO: 1038 - RNA, 1236 nt, Artificial Sequence
  derived and/or modified CDS sequence (opt5) from MERS-CoV__AFY13314__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaucuucuguaucucgaccugcugaaccggcuccaggcccuggaauccggcaaggugaaacaaagccagcccaagguuaucaccaaaaaggaugcugccgccgcuaaaaauaagaugcgccauaagagaacaucuaccaaauccuuuaacauggugcaggcguucgggcuucggggacccggcgaccugcagggcaauuuuggggaucuccaacugaacaaacuuggaaccgaggacccuagauggccgcagauugccgaacuggcucccacagccagcgccuucaugggcaugucucaguuuaaacucacgcaccaaaauaacgaugaccaugggaauccugucuacuuccugcgcuauagcggagcuaucaagcuggaccccaaaaacccuaauuacaacaaguggcucgagcugcuugagcagaauauugaugccuacaaaaccuuucccaagaaggaaaagaagcagaaagcgccgaaggaggaauccacagaccagaugucugagccucccaaagagcaccgggugcaaggcacccagagaacacgcacccggccuagcgugcagcccgggccuaugaucgaugucaacacggacuga

SEQ ID NO: 1039 - RNA, 1242 nt, Artificial Sequence
  derived and/or modified CDS sequence (opt5) from MERS-CoV__AGH58724__N
auggccagccccgcugccccuagagcgguguccuucgcuuacaacaaugacaucaccaacacaaaucugucucggggccgcgggagaaacccgaagccccgggccgccccuaauaacacggucagcugguauaccggacucacacagcacggcaaaguuccccugaccuuuccucccgggcaaggagugccucuuaaugcuaacuccacaccggcccagaaugcuggcuacuggcgcagacaggaucggaagauuaacaccgggaauggaaucaaacagcuggcgccccgcugguauuucuacuauacaggcaccggcccugaggccgcccuccccuuuagagcugugaaggacgggauugucugggugcaugaagauggagccacggacgcuccuucuaccuucggcacacggaaccccaauaacgauagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaccuucuguaccucgaucugcugaaccggcuccaggcccuggaauccggcaaggugaaacaaagccagcccaagguuaucaccaaaaaggacgcugccgccgcuaaaaauaagaugcgccauaagagaacaucuaccaaauccuuuaacauggugcaggcguucgggcuucggggacccggcgaucugcagggcaauuuuggggaccuccaacugaacaaacuuggaaccgaggauccuagauggccgcagauugccgaacuggcucccacagccagcgccuucaugggcaugucucaguuuaaacucacgcaccaaaauaacgacgaucaugggaauccugucuauuuccugcgcuacagcggagcuaucaagcuggaccccaaaaacccuaauuacaacaaguggcucgagcugcuugagcagaauauugacgccuauaaaaccuuucccaagaaggaaaagaagcagaaagcgccgaaggaggaauccacagaucagaugucugagccucccaaagagcaacgggugcagggcagcaucacccagagaacacgcacccggccuuccgugcagcccgggccuaugauugacgucaacacggauuga

SEQ ID NO: 1040 - RNA, 1242 nt, Artificial Sequence
  derived and/or modified CDS sequence (opt5) from MERS-CoV__AGV08397__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaucuucuguaucucgaccugcugaaccggcuccaggcccuggaauccggcaaggugaaacaaagccagcccaagguuaucaccaaaaaggaugcugccgccgcuaaaaauaagaugcgccauaagagaacaucuaccaaauccuuuaacauggugcaggcguucgggcuucggggacccggcgaccugcagggcaauuuuggggaucuccaacugaacaaacuuggaaccgaggacccuagauggccgcagauugccgaacuggcucccacagccagcgccuucaugggcaugucucaguuuaaacucacgcaccaaaauaacgaugaccaugggaauccugucuacuuccugcgcuauagcggagcuaucaagcuggaccccaaaaacccuaauuacaacaaguggcucgagcugcuugagcagaauauugaugccuacaaaaccuuucccaagaaggaaaagaagcagaaagcgccgaaggaggaacugacagaccagauguccgagccucccaaagagcaacgggugcagggcucuaucacccagagaacacgcacccggccuagcgugcagcccgggccuaugauugaugucaacacggacuga

SEQ ID NO: 1041 - RNA, 1242 nt, Artificial Sequence
  derived and/or modified CDS sequence (opt5) from MERS-CoV__AGV08415__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaucuucuguaucucgaccugcugaaccggcuccaggcccuggaauccggcaaggugaaacaaagccagcccaagguuaucaccaaaaaggaugcugccgccgcuaaaaauaagaugcgccauaagagaacaucuaccaaauccuuuaacauggugcaggcguucgggcuucggggacccggcgaccugcagggcaauuuuggggaucuccaacugaacaaacuuggaaccgaggacccuagauggccgcagauugccgaacuggcucccacagccagcgccuucaugggcaugucucaguuuaaacucacgcaccaaaauaacgaugaccaugggaauccugucuacuuccugcgcuauagcggagcuaucaagcuggaccccaaaaacccuaauuacaacaaguggcucgagcugcuugagcagaauauugaugccuacaaaaccuuucccaagaaggaaaagaagcagaaagcgccgaaggaggaauccacagaccagaugucugagccucccaaagagcaacgggugcagggcagcaucacccagagaacacgcacccggccuuccgugcagcccgggccuaugauugaugucaacacggacuga

SEQ ID NO: 1042 - RNA, 1242 nt, Artificial Sequence
  derived and/or modified CDS sequence (opt5) from MERS-CoV__AGV08487__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaacacggagccacggacgcuccuucuaccuucggcacacggaaccccaauaacgauagcgccaucguuacccaauuugcgccggggacaaaacugccuaagaauuuccauauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaccuucuguaucucgaucugcugaaccggcuccaggcccuggaauccggcaaggugaaacaaagccagcccaagguuaucaccaaaaaggacgcugccgccgcuaaaaauaagaugcgccacaagagaacaucuaccaaauccuuuaacauggugcaggcguucgggcuucggggacccggcgaucugcagggcaauuuuggggaccuccaacugaacaaacuuggaaccgaggauccuagauggccgcagauugccgaacuggcucccacagccagcgccuucaugggcaugucucaguuuaaacucacgcaucaaaauaacgacgaucacgggaauccugucuacuuccugcgcuauagcggagcuaucaagcuggaccccaaaaacccuaauuacaacaaguggcucgagcugcuugagcagaauauugacgccuacaaaaccuuucccaagaaggaaaagaagcagaaagcgccgaaggaggaauccacagaucagaugucugagccucccaaagagcaacgggugcagggcagcaucacccagagaacacgcacccggccuuccgugcagcccgggccuaugauugacgucaacacggauuga

SEQ ID NO: 1043 - RNA, 1242 nt, Artificial Sequence
  derived and/or modified CDS sequence (opt5) from MERS-CoV__AHC74095__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgaccuggccaucguuacccaauuugcgccggggacaaaacuuccuaagaauuuccacauugagggaaccggcgggaacagccaguccucuagccgcgccuccagcgugucuagaaacuccagccggucuuccagccagggaucucgcuccggcaauagcacgagaggcacaucccccgggccuucuggaaucggcgcugucgggggagaucugcucuaucuggaccugcucaaccggcugcaggcccuugaaagcggcaaggugaaacaaucccagcccaagguuaucaccaaaaaggaugcugccgccgcuaaaaauaagaugcgccauaagagaacaagcaccaaaucuuuuaacauggugcaggcguucgggcugcggggacccggcgaccuccagggcaauuuuggggaucugcaacuuaacaagcugggaaccgaggacccuagauggccgcagauugccgaacucgcucccacagccuccgccuucaugggcaugagccaguuuaaacugacgcaccaaaauaacgaugaccaugggaauccugucuacuuccugcgcuauucuggagcuaucaagcucgaccccaaaaacccuaauuacaacaaguggcuggagcuucuggagcagaauauugaugccuacaaaaccuuucccaagaaggagaaaaagcagaaagcgccgaaggaagaaagcacagaccagauguccgagccucccaaagagcaacgggugcagggcucuaucacccagagaacacgcacccggccuagcgugcagcccgggccuaugauugaugucaacacggacuga

SEQ ID NO: 1044 - RNA, 1242 nt, Artificial Sequence
  derived and/or modified CDS sequence (opt5) from MERS-CoV__AHI48535__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuuccccugggcaaggagugccccuuaaugcuaacucuaccccugcccagaaugcuggcuauuggcgcagacaggaccggaagauuaacacagggaauggaaucaaacagcuggccccgcgcugguacuucuauuacacaggcaccggccccgaggcggcccucccuuuuagagcugugaaggaugggauugucugggugcaugaagacggagccacggaugcucccagcaccuucggcacacggaacccuaauaacgacuccgccaucguuacccaauuugcgcccgggacaaaacugccgaagaauuuccacauugagggaaccggcgggaacucucagagcuccagccgcgccucuuccgugagcagaaacucuucccggagcagcucccagggaagccgcuccggcaauucuacgagaggcacaagcccugggcccuccggaaucggcgcugucgggggagaucuucuguaucucgaccugcugaaccggcuccaggcccuggaaagcggcaaggugaaacaaucucagccuaagguuaucaccaaaaaggaugcugccgccgcuaaaaauaagaugcgccauaagagaacauccaccaaaucuuuuaacauggugcaggcguucgggcuucggggacccggcgaccugcagggcaauuuuggggaucuccaacugaacaaacuuggaaccgaggaccccagauggccucagauugccgaacuggcuccgacagccucugccuucaugggcaugagccaguuuaaacucacgcaccaaaauaacgaugaccaugggaaucccgucuacuuccugcgcuauuccggagcuaucaagcuggacccuaaaaaccccaauuacaacaaguggcucgagcugcuugagcagaauauugaugccuacaaaaccuuuccuaagaaggaaaagaagcagaaagcgcccaaggaggaaucuacagaccaggugagcgagccgccuaaagagcaacgggugcagggcaucauuacccagagaacacgcacccggcccuccguccagccugggcccaugaucgauguuaacacggacuga

SEQ ID NO: 1045 - RNA, 1242 nt, Artificial Sequence
  derived and/or modified CDS sequence (opt5) from MERS-CoV__AIL23941__N
auggccagccuggcugcccccagagcgguguccuucgcugacaacaaugauaucaccaacacaaaucucucucggggccgcgggagaaacccuaagccgcgggccgcccccaauaacacggucagcugguacaccggacugacacagcacggcaaaguuccucuuaccuuucccccugggcaaggagugccccugaaugcuaacuccaccccugcccagaaugcuggcuauuggcgcagacaggaccggaagauuaacacagggaauggaaucaaacagcucgccccgcgcugguacuucuauuacacaggcaccggccccgaggcggcccugccuuuuagagcugugaaggaugggauugucugggugcaugaacacggagccacggacgcucccucuaccuucggcacacggaacccuaauaacgauagcgccaucguuacccaauuugcgcccgggacaaaacuuccgaagaauuuccauauugagggaaccggcgggaacucccagucuagcucccgcgccagcucuguguccagaaacagcucucgguccagcucucagggaucccgcagcggcaauuccacgagaggcacaucuccugggcccagcggaaucggcgcugucgggggagaccugcucuaucuggaucugcucaaccggcugcaggcccuugaauccggcaaggugaaacaaagccagccuaagguuaucaccaaaaaggacgcugccgccgcuaaaaauaagaugcgccacaagagaacaucuaccaaauccuuuaacauggugcaggcguucgggcugcggggacccggcgaucuccagggcaauuuuggggaccugcaacuuaacaagcugggaaccgaggaucccagauggccucagauugccgaacucgcuccgacagccagcgccuucaugggcaugucucaguuuaaacugacgcaucaaaauaacgacgaucacgggaaucccgucuacuuccugcgcuauagcggagcuaucaagcucgacccuaaaaaccccaauuacaacaaguggcuggagcuucuggagcagaauauugacgccuacaaaaccuuuccuaagaaggagaaaaagcagaaagcgcccaaggaagaauccacagaucagaugucugagccgccuaaagagcaacgggugcagggcagcaucacccagagaacacgcacccggcccuccgugcagccugggcccaugauugacgucaacacggauuga

SEQ ID NO: 1046 - RNA, 1242 nt, Artificial Sequence
  derived and/or modified CDS sequence (opt5) from MERS-CoV__AIL23996__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgaccuggccaucguuacccaauuugcgccggggacaaaacuuccuaagaauuuccacauugagggaaccggcgggaacagccaguccucuagccgcgccuccagcgugucuagaaacuccagccggucuuccagccagggaucucgcuccggcaauagcacgagaggcacaucccccgggccuucuggaaucggcgcugucgggggagaucugcucuaucuggaccugcucaaccggcugcaggcccuugaaagcggcaaggugaaacaaucccagcccaagguuaucaccaaaaaggaugcugccgccgcuaaaaauaagaugcgccauaagagaacaagcaccaaaucuuuuaacauggugcaggcguucgggcugcggggacccggcgaccuccagggcaauuuuggggaucugcaacuuaacaagcugggaaccgaggacccuagauggccgcagauugccgaacucgcucccacagccuccgccuucaugggcaugagccaguuuaaacugacgcaccaaaauaacgaugaccaugggaauccugucuacuuccugcgcuauucuggagcuaucaagcucgaccccaaaaacccuaauuacaacaaguggcuggagcuucuggagcagaauauugaugccuacaaaaccuuucccaagaaggagaaaaagcagaaagcgccgaaggaagaaagcacagaccagauguccgagccucccaaagagcaacgggugcagggcucuaucacccagcacacaagaacccgcccuagcgugcagcccgggccuaugauugaugucaacacggacuga

SEQ ID NO: 1047 - RNA, 1242 nt, Artificial Sequence
  derived and/or modified CDS sequence (opt5) from MERS-CoV__AIY60565__N
auggccgcucccgccgcgccuagagcugugagcuucgccgacaacaaugauaucaccaacacaaaucugucccggggccgcgggagaaacccgaagccccgggccgcuccuaauaacacggucucuugguacaccggacucacacagcacggcaaaguuccccugaccuuuccucccgggcaaggagugccucuuaaugccaacagcacaccggcucagaaugccggcuauuggcgcagacaggaccggaagauuaacaccgggaauggaaucaaacagcuggcgccccgcugguacuucuauuacacaggcaccggcccugaggccgcucuccccuuuagagccgugaaggaugggauugucugggugcaugaagacggagcuacggaugccccuuccaccuucggcacacggaaccccaauaacgacucugcgaucguuacccaauuugccccggggacaaaacugccuaagaauuuccacauugagggaaccggcgggaacagccaguccucuagccgcgcuuccagcgugucuagaaacuccagccggucuuccagccagggaucucgcuccggcaauagcacgagaggcacaucccccgucccuucugggaucggagccgugggcggggaucuucuguaucucgaccugcugaaccggcuccaggcucuggaaagcggaaagguuaaacaaucccagcccaaggugaucaccaaaaaggaugccgccgcugcgaaaaauaagaugcgccauaagagaacaagcaccaaaucuuuuaacaugguccaggccuucggccuucgggggcccggagaccugcagggcaauuuuggcgaucuccaacugaacaaacuugggaccgaggacccuagauggccgcagauugcugaacuggcccccacagccuccgcuuucaugggaaugagccaguuuaaacucacgcaccaaaauaacgaugaccauggcaauccuguguacuuccugcgcuauucuggggccaucaagcuggaccccaaaaacccuaauuacaacaaguggcucgagcugcuugagcagaauauugaugcguacaaaaccuuucccaagaaggaaaagaagcagaaagcuccgaaggaggaaagcacagaccagauguccgagccucccaaagagcaacgggugcagggaucuaucacccagagaacacgcacccggccuagcguccagcccggcccuaugauugauguuaacacggacuga

SEQ ID NO: 1048 - RNA, 1242 nt, Artificial Sequence
  derived and/or modified CDS sequence (opt5) from MERS-CoV__AIZ74424__N
auggccgcucccgccgcgccuagagcugugagcuucgccgacaacaaugauaucaccaacacaaaucugucccggggccgcgggagaaacccgaagccccgggccgcuccuaauaacacggucucuugguacaccggacucacacagcacggcaaaguuccccugaccuuuccucccgggcaaggagugccucuuaaugccaacagcacaccggcucagaaugccggcuauuggcgcagacaggaccggaagauuaacaccgggaauggaaucaaacagcuggcgccccgcugguacuucuauuacacaggcaccggcccugaggccgcucuccccuuuagagccgugaaggaugggauugucugggugcaugaagacggagcuacggaugccccuuccaccuucggcacacggaaccccaauaacgacucugcgaucguuacccaauuugccccggggacaaaacugccuaagaauuuccacauugagggaaccggcgggaacagccaguccucuagccgcgcuuccagcgugucuagaaacuccagccggucuuccagccagggaucucgcuccggcaauagcacgagaggcacaucccccgggccuucuggaaucggcgccgucgggggagaucuucuguaucucgaccugcugaaccggcuccaggcucuggaaagcggcaaggugaaacaaucccagcccaagguuaucaccaaaaaggaugccgccgcugcgaaaaauaagaugcgccauaagagaacaagcaccaaaucuuuuaacauggugcaggccuucgggcuucggggacccggcgaccugcagggcaauuuuggggaucuccaacugaacaaacuuggaaccgaggacccuagauggccgcagauugcugaacuggcccccacagccuccgcuuucaugggcaugagccaguuuaaacucacgcaccaaaauaacgaugaccaugggaauccugucuacuuccugcgcuauucuggagccaucaagcuggaccccaaaaacccuaauuacaacaaguggcucgagcugcuugagcagaauauugaugcguacaaaaccuuucccaagaaggaaaagaagcagaaagcuccgaaggaggaaagcacagaccagauguccgagccucccaaagagcaacgggugcagggcucuaucacccagagaacacgcacccggccuagcgugcagcccgggccuaugauugaugucaacacggacuga

SEQ ID NO: 1049 - RNA, 1242 nt, Artificial Sequence; identical to SEQ ID NO: 1048
  derived and/or modified CDS sequence (opt5) from MERS-CoV__AIZ74430__N

SEQ ID NO: 1050 - RNA, 1242 nt, Artificial Sequence
  derived and/or modified CDS sequence (opt5) from MERS-CoV__AKI29291__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcccccagaugguacuucuauuacacaggcaccggcccugaggcggcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaucuucuguaucucgaccugcugaaccggcuccaggcccuggaauccggcaaggugaaacaaagccagcccaagguuaucaccaaaaaggaugcugccgccgcuaaaaauaagaugcgccauaagagaacaucuaccaaauccuuuaacauggugcaggcguucgggcuucggggacccggcgaccugcagggcaauuuuggggaucuccaacugaacaaacuuggaaccgaggacccuagauggccgcagauugccgaacuggcucccacagccagcgccuucaugggcaugucucaguuuaaacucacgcaccaaaauaacgaugaccaugggaauccugucuacuuccugcgcuauagcggagcuaucaagcuggaccccaaaaacccuaauuacaacaaguggcucgagcugcuugagcagaauauugaugccuacaaaaccuuucccaagaaggaaaagaagcagaaagcgccgaaggaggaauccacagaccagaugucugagccucccaaagagcaacgggugcagggcagcaucacccagcgcauucgcacacggccuuccgugcagcccgggccuaugaucgaugucaacaccgacuga

SEQ ID NO: 1051 - RNA, 1242 nt, Artificial Sequence
  derived and/or modified CDS sequence (opt5) from MERS-CoV__AKK52599__N
auggccagccccgcugccccuugcgcgguguccuucgcugacaacaaugauaucaccaacacaaaucugucuagaggccgggggcgcaacccgaagcccagagccgccccuaauaacacggucagcugguacaccggacucacacagcacggcaaaguuccccugaccuuuccucccgggcaaggagugccucuuaaugcuaacuccacaccggcccagaaugcuggcuauuggcggcgccaggacagaaagauuaacaccgggaauggaaucaaacagcuggcgccccggugguacuucuauuacacaggcaccggcccugaggccgcccuccccuuucgcgcugugaaggaugggauugucugggugcaugaagacggagccacggaugcuccuucuaccuucggcacaagaaaccccaauaacgacagcgccaucguuacccaauuugcgccggggacaaaacugccuaagaauuuccacauugagggaaccggcgggaacucccagucuagcucccgggccagcucugugucccgcaacagcucuagauccagcucucagggaucccggagcggcaauuccacgcgcggcacaucucccgggccuagcggaaucggcgcugucgggggagaucuucuguaucucgaccugcugaacagacuccaggcccuggaauccggcaaggugaaacaaagccagcccaagguuaucaccaaaaaggaugcugccgccgcuaaaaauaagaugcggcauaagcgcacaucuaccaaauccuuuaacauggugcaggcguucgggcuuagaggacccggcgaccugcagggcaauuuuggggaucuccaacugaacaaacuuggaaccgaggacccucgguggccgcagauugccgaacuggcucccacagccagcgccuucaugggcaugucucaguuuaaacucacgcaccaaaauaacgaugaccaugggaauccugucuacuuccugagauauagcggagcuaucaagcuggaccccaaaaacccuaauuacaacaaguggcucgagcugcuugagcagaauauugaugccuacaaaaccuuucccaagaaggaaaagaagcagaaagcgccgaaggaggaauccacagaccagaugucugagccucccaaagagcaacgcgugcagggcagcaucacccagcggacaagaacccgcccuuccgugcagcccgggccuaugauugaugucaacacggacuga

SEQ ID NO: 1052 - RNA, 1242 nt, Artificial Sequence
  derived and/or modified CDS sequence (opt5) from MERS-CoV__AKN24774__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgaccuggccaucguuacccaauuugcgccggggacaaaacuuccuaagaauuuccacauugagggaaccggcgggaacagccaguccucuagccgcgccuccagcgugucuagaaacuccagccggucuuccagccagggaucucgcuccggcaauagcacgagaggcacaucccccgggccuucuggaaucggcgcugucgggggagaucugcucuaucuggaccugcucaaccggcugcaggcccuugaaagcggcaaggugaaacaaucccagcccaagguuaucaccaaaaaggaugcugccgccgcuaaaaauaagaugcgccauaagagaacaagcaccaaaucuuuuaacauggugcaggcguucgggcugcggggacccggcgaccuccagggcaauuuuggggaucugcaacuuaacaagcugggaaccgaggacccuagauggccgcagauugccgaacucguccccacagcuuccgccuucaugggcaugagccaguuuaaacugacgcaccaaaauaacgaugaccaugggaauccuguguacuuccugcgcuauucuggagccaucaagcucgaccccaaaaacccuaauuacaacaaguggcuggagcuucuggagcagaauauugaugcuuacaaaaccuuucccaagaaggagaaaaagcagaaagccccgaaggaagaaagcacagaccagauguccgagccucccaaagagcaacgggugcagggcucuaucacccagcacacaagaacccgcccuagcguccagcccgggccuaugauugauguuaacacggacuga

SEQ ID NO: 1053 - RNA, 1242 nt, Artificial Sequence
  derived and/or modified CDS sequence (opt5) from MERS-CoV__ALW82676__N
auggccagccccgcugccccuagagcgguguccuucgcugacaacaaugauaccacaaacacgaaucugucucggggccgcgggagaaacccgaagccccgggccgccccuaauaacaccgucagcugguacacaggacucacccagcacggcaaaguuccccugacauuuccucccgggcaaggagugccucuuaaugcuaacuccaccccggcccagaaugcuggcuauuggcgcagacaggaccggaagaucaacacagggaauggaauuaaacagcuggcgccccgcugguacuucuauuacaccggcacgggcccugaggccgcccuccccuuuagagcugugaaggaugggaucgucugggugcaugaagacggagccaccgaugcuccuucuacauucggcacccggaaccccaauaacgacagcgccauuguuacacaauuugcgccggggaccaaacugccuaagaauuuccacaucgagggaacgggcgggaacucccagucuagcucccgcgccagcucuguguccagaaacagcucucgguccagcucucagggaucccgcagcggcaauuccacaagaggcaccucucccgggccuagcggaauuggcgcugucgggggagaucuucuguaucucgaccugcugaaccggcuccaggcccuggaauccggcaaggugaaacaaagccagcccaagguuaucacaaagaaggaugcugccgccgcuaaaaauaagaugcgccauaagagaaccucuaccaaauccuuuaacauggugcaggcguucgggcuucggggacccggcgaccugcagggcaauuuuggggaucuccaacugaacaaacuuggaacagaggacccuagauggccgcagaucgccgaacuggcucccacggccagcgccuucaugggcaugucucaguuuaaacucacccaccaaaauaacgaugaccaugggaauccugucuacuuccugcgcuauagcggagcuauuaagcuggaccccaaaaacccuaauuacaacaaguggcucgagcugcuugagcagaauaucgaugccuacaaaacauuucccaagaaggagaaaaagcagaaagcgccgaaggaagaauccaccgaccagaugucugagccucccaaagagcaacgggugcagggcagcauuacacagagaacccgcacgcggccuuccgugcagcccgggccuaugaucgaugucaacacagacuga

SEQ ID NO: 1054 - RNA, 1242 nt, Artificial Sequence
  derived and/or modified CDS sequence (opt5) from MERS-CoV__AMQ49033__N
auggccagccccgcugccccuagagcgguguucuuugcugacaacaaugauaucaccaacacaaaucugucccggggccgcgggagaaacccgaagccccgggccgccccuaauaacacggucucuugguacaccggacucacacagcacggcaaaguuccccugaccuucccucccgggcaaggagugccucuuaaugcuaacagcacaccggcccagaaugcuggcuauuggcgcagacaggaccggaagauuaacaccgggaauggaaucaaacagcuggcgccccgcugguacuuuuauuacacaggcaccggcccugaggccgcccuccccuucagagcugugaaggaugggauugucugggugcaugaagacggagccacggaugcuccuuccaccuuuggcacacggaaccccaauaacgacucugccaucguuacccaauucgcgccggggacaaaacugccuaagaauuuucacauugagggaaccggcgggaacagccaguccucuagccgcgccuccagcgugucuagaaacuccagccggucuuccagccagggaucucgcuccggcaauagcacgagaggcacaucccccgggccuucuggaaucggcgcugucgggggagaucuucuguaucucgaccugcugaaccggcuccaggcccuggaaagcggcaaggugaaacaaucccagcccaagguuaucaccaaaaaggaugcugccgccgcuaaaaauaagaugcgccauaagagaacaagcaccaaaucuuucaacauggugcaggcguuugggcuucggggacccggcgaccugcagggcaauuucggggaucuccaauuuaacaagcugggaaccgaggacccuagauggccgcagauugccgaacuugcucccacagccuccgccuucaugggcaugagccaguuuaaacugacgcaccaaaauaacgaugaccaugggaauccugucuacuuccuccgcuauucuggagcuaucaagcuggaccccaaaaacccuaauuacaacaaguggcuggagcuccuggagcagaauauugaugccuacaaaaccuuccccaagaaggagaaaaagcagaaagcgccgaaggaagaaagcacagaccagauguccgagccucccaaagagcaacgggugcagggcucuaucacccagagaacacgcacccggccuagcgugcagcccgggccuaugauugaugucaacacggacuga

SEQ ID NO: 1055 - RNA, 1242 nt, Artificial Sequence
  derived and/or modified CDS sequence (opt5) from MERS-CoV__AHL18098__N
auggccagcuccgcugcccccagagcggugucuuucgcugacaacaaugauaucaccaacacaaaucugagccggggccgcgggagaaacccuaagccgcgggccgcccccaauaacacggucuccugguacaccggacucacacagcacggcaaaguuccucugaccuuucccccugggcaaggagugccccuuaaugcuaacucuaccccugcccagaaugcuggcuauuggcgcagacaggaccggaagauuaacacagggaauggaaucaaacagcuggccccgcgcugguacuucuauuacacaggcaccggccccgaggcggcccucccuuuuagagcugugaaggaugggauugucugggugcaugaagacggagccacggaugcucccagcaccuucggcacacggaacccuaauaacgacuccgccaucguuacccaauuugcgcccgggacaaaacugccgaagaauuuccacauugagggaaccggcgggaacucucagagcuccagccgcgccucuuccgugagcagaaacucuucccggucuagcucccagggaagccgcuccggcaauucuacgagaggcacaagcccugggcccuccggaaucggcgcugucgggggagaucuucuguaucucgaccugcugaaccggcuccaggcccuggaaagcggcaaggugaaacaaucucagccuaagguuaucaccaaaaaggaugcugccgccgcuaaaaauaagaugcgccauaagagaacauccaccaagagcuuuaacauggugcaggcguucgggcuucggggacccggcgaccugcagggcaauuuuggggaucuccaacugaacaaacuuggaaccgaggaccccagauggccucagauugccgaacuggcuccgacagccucugccuucaugggcaugagccaguuuaaacucacgcaccaaaauaacgaugaccaugggaaucccgucuacuuccugcgcuauuccggagcuaucaagcuggacccuaaaaaccccaauuacaacaaguggcucgagcugcuugagcagaauauugaugccuacaaaaccuuuccuaagaaggaaaacaaacagaaggcgcccaaagaggaaucuacagaccagaugagcgagccgccuaaggagcaacgggugcagggcuccaucacccagagaacacgcacccggcccagcgugcagccugggcccaugauugaugucaauacggacuga

SEQ ID NO: 1056 - RNA, 1242 nt, Artificial Sequence
  derived and/or modified CDS sequence (opt5) from MERS-CoV__AHX00738__N
auggccgcucccgccgcgccuagagcugugagcuucgccgacaacaaugauaucaccaacacaaauaugucccggggccgcgggagaaacccgaagccccgggccgcuccuaauaacacggucucuugguacaccggacugacacagcacggcaaaguuccccucaccuuuccucccgggcaaggagugccucugaaugccaacagcacaccggcucagaaugccggcuauuggcgcagacaggaccggaagauuaacaccgggaauggaaucaaacagcuugcgccccgcugguacuucuauuacacaggcaccggcccugaggccgcucugcccuuuagagccgugaaggaugggauugucugggugcaugaagacggagcuacggaugccccuuccaccuucggcacacggaaccccaauaacgacucugcgaucguuacccaauuugccccggggacaaaacucccuaagaauuuccacauugagggaaccggcgggaacagccaguccucuagccgcgcuuccagcgugucuagaaacuccagccggucuuccagccagggaucucgcuccggcaauagcacgagaggcacaucccccgggccuucuggaaucggcgccgucgggggagaucugcuuuaucuggaccuccugaaccggcugcaggcucucgaaagcggcaaggugaaacaaucccagcccaagguuaucaccaaaaaggaugccgccgcugcgaaaaauaagaugcgccauaagagaacaagcaccaaaucuuuuaacauggugcaggccuucgggcugcggggacccggcgaccuucagggcaauuuuggggaucugcaacucaacaagcugggaaccgaggacccuagauggccgcagauugcugaacuugcccccacagccuccgcuuucaugggcaugagccaguuuaaacugacgcaccaaaauaacgaugaccaugggaauccugucuacuuccuccgcuauucuggagccaucaagcuggaccccaaaaacccuaauuacaacaaguggcuggagcuccuggagcagaauauugaugcguacaaaaccuuucccaagaaggagaaaaagcagaaagcuccgaaggaagaaagcacagaccagauguccgagccucccaaagagcaacgggugcagggcucuaucacccagagaacacgcacccggccuagcgugcagcccgggccuaugauugaugucaacacggacuga

SEQ ID NO: 1057 - RNA, 1242 nt, Artificial Sequence
  derived and/or modified CDS sequence (opt5) from MERS-CoV__AHY22561__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggccuagcggaaucggcgcugucgggggagaucuucuguaucucgaccugcugaaccggcuccaggcccuggaauccggcaaggugaaacaaagccagcccaagguuaucaccaaaaaggaugcugccgccgcuaaaaauaagaugcgccauaagagaacaucuaccaaauccuuuaacauggugcaggcguucgggcuucggggacccggcgaccugcagggcaauuuuggggaucuccaacugaacaaacuuggaaccgaggacccuagauggccgcagauugccgaacuggcucccacagccagcgccuucaugggcaugucucaguuuaagcucacgcaccaaaauaacgaugaccaugggaauccugucuacuuccugcgcuauagcggagcuaucaagcuggaccccaaaaacccuaauuacaacaaguggcucgagcugcuugagcagaauauugaugccuacaaaaccuuucccaagaaggaaaacaaacagaaggcgccgaaagaggaauccacagaccagaugucugagccucccaaggagcaacgggugcagggcagcaucacccagagaacacgcacccggccuuccgugcagcccgggccuaugauugaugucaauacggacuga

SEQ ID NO: 1058 - RNA, 1242 nt, Artificial Sequence
  derived and/or modified CDS sequence (opt5) from MERS-CoV__AHY22571__N
auggccgcucccgccgcgccuagagcugugagcuucgccgacaacaaugauaucaccaacacaaaucugucccggggccgcgggagaaacccgaagccccgggccgcuccuaauaacacggucucuugguacaccggacucacacagcacggcaaaguuccccugaccuuuccucccgggcaaggagugccucuuaaugccaacagcacaccggcucagaaugccggcuauuggcgcagacaggaccggaagauuaacaccgggaauggaaucaaacagcuggcgccccgcugguacuucuauuacacaggcaccggcccugaggccgcucuccccuuuagagccgugaaggaugggauugucugggugcaugaagacggagcuacggaugccccuuccaccuucggcacacggaaccccaauaacgacucugcgaucguuacccaauuugccccggggacaaaacugccuaagaauuuccacauugagggaaccggcgggaacagccaguccucuagccgcgcuuccagcgugucuagaaacuccagccggucuuccagccagggaucucgcuccagaaauagcacgcggggcacaucccccggcccuucugggaucggagccgucggcggggaucuucuguaucucgaccugcugaaccgccuccaggcucuggaaagcggaaaggugaaacaaucccagcccaagguuaucaccaaaaaggaugccgccgcugcgaaaaauaagaugagacauaagcggacaagcaccaaaucuuuuaacauggugcaggccuucggccuuagagggcccggagaccugcagggcaauuuuggcgaucuccaacugaacaaacuugggaccgaggacccucgcuggccgcagauugcugaacuggcccccacagccuccgcuuucaugggaaugagccaguuuaagcucacgcaccaaaauaacgaugaccauggcaauccugucuacuuccugcgguauucuggggccaucaagcuggaccccaaaaacccuaauuacaacaaguggcucgagcugcuugagcagaauauugaugcguacaaaaccuuucccaagaaggaaaacaaacagaaggcuccgaaagaggaaagcacagaccagauguccgagccucccaaggagcaaagagugcagggaucuaucacccagcgcacacggaccagaccuagcgugcagcccggcccuaugauugaugucaauacggacuga

SEQ ID NO: 1059 - RNA, 1242 nt, Artificial Sequence
  derived and/or modified CDS sequence (opt5) from MERS-CoV__ALA49381__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcucuagccccgggccuuccggaaucggcgcugucgggggagaucuucuguaucucgaccugcugaaccggcuccaggcccuggaaagcggcaaggugaaacaaucucagcccaagguuaucaccaaaaaggaugcugccgccgcuaaaaauaagaugcgccauaagagaacauccacaaagagcuuuaacauggugcaggcguucgggcuucggggacccggcgaccugcagggcaauuuuggggaucuccaacugaacaaacuuggaaccgaggacccuagauggccgcagauugccgaacuggcucccaccgccucugccuucaugggcaugagccaguuuaaacucacacaccaaaauaacgaugaccaugggaauccugucuacuuccugcgcuauuccggagcuaucaagcuggaccccaaaaacccuaauuacaacaaguggcucgagcugcuugagcagaauauugaugccuacaaaacguuucccaagaaggagaaaaagcagaaagcgccgaaggaagaaucuaccgaccagaugagcgagccucccaaagagcaacgggugcagggcuccaucacacagagaacccgcacacggccuagcgugcagcccgggccuaugauugaugucaacaccgacuga

SEQ ID NO: 1060 - RNA, 1242 nt, Artificial Sequence
  derived and/or modified CDS sequence (opt5) from MERS-CoV__ALA49392__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcucuagccccgggccuuccggaaucggcgcugucgggggagaucuucuguaucucgaccugcugaaccggcuccaggcccuggaaagcggcaaggugaaacaaucucagcccaagguuaucaccaaaaaggaugcugccgccgcuaaaaauaagaugcgccauaagagaacauccacaaagagcuuuaacauggugcaggcguucgggcuucggggacccggcgaccugcagggcaauuuuggggaucuccaacugaacaaacuuggaaccgaggacccuagauggccgcagauugccgaacuggcucccaccgccucugccuucaugggcaugagccaguuuaaacucacacaccaaaauaacgaugaccaugggaauccugucuacuuccugcgcuauuccggagcuaucaagcuggaccccaaaaacccuaauuacaacaaguggcucgagcugcuugagcagaauauugaugccuacaaaacguuucccaagaaggagaaaaagcagaaagcgccgaaggaagaaucuaccgaccagaugagcgagccucccaaagagcaacgggugagaggcuccaucacacagcgcacccggacaagaccuagcgugcagcccgggccuaugauugaugucaacaccgacuga

SEQ ID NO: 1061 - RNA, 1242 nt, Artificial Sequence
  derived and/or modified CDS sequence (opt5) from MERS-CoV__ALA49601__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaggcacaucucccgggcuuagcggaaucggcgcugucgggggagaucugcucuaucuggaccugcucaaccggcugcaggcccuugaauccggcaaggugaaacaaagccagccuaagguuaucaccaaaaaggaugcugccgccgcuaaaaauaagaugcgccauaagagaacaucuaccaaauccuuuaacauggugcaggcguucgggcugcggggacccggcgaccuccagggcaauuuuggggaucugcaacuuaacaagcugggaaccgaggaccccagauggccucagauugccgaacucgcuccgacagccagcgccuucaugggcaugucucaguuuaaacugacgcaccaaaauaacgaugaccaugggaaucccgucuacuuccugcgcuauagcggagcuaucaagcucgacccuaaaaaccccaauuacaacaaguggcuggagcuucuggagcagaauauugaugccuacaaaaccuuuccuaagaaggagaaaaagcagaaagcgcccaaggaagaauccacagaccagaugucugagccgccuaaagagcaacgggugcagggcagcaucacccagagaacacgcacccggcccuccgugcagccugggcccaugauugaugucaacacggacuga

SEQ ID NO: 1062 - RNA, 1242 nt, Artificial Sequence
  derived and/or modified CDS sequence (opt5) from MERS-CoV__ALA49843__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaagacggagccacggaugcuccuucuaccuucggcacacggaaccccaauaacgacagcgccaucguuacccaauuugcgccggggacaaaacugccuaagaauuuccacauugagggaaccggcgggaacucccagucuagcucccgcgccagcucuguguccagaaacagcucucgguccagcucucagggaucccgcagcggcaauuccacgagaugcacaucucccggcccuagcgggaucggagcugucggcggggaucuucuguaucucgaccugcugaaccggcuccaggcccuggaauccggaaaggugaaacaaagccagcccaagguuaucaccaaaaaggaugcugccgccgcuaaaaauaagaugcgccauaagagaacaucuaccaaauccuuuaacauggugcaggcguucggccuucgggggcccggagaccugcagggcaauuuuggcgaucuccaacugaacaaacuugggaccgaggacccuagauggccgcagauugccgaacuggcucccacagccagcgccuucaugggaaugucucaguuuaaacucacgcaccaaaauaacgaugaccauggcaauccugucuacuuccugcgcuauagcggggcuaucaagcuggaccccaaaaacccuaauuacaacaaguggcucgagcugcuugagcagaauauugaugccuacaaaaccuuucccaagaaggaaaagaagcagaaagcgccgaaggaggaauccacagaccagaugucugagccucccaaagagcaacgggugcagggaagcaucacccagagaacacgcacccggccuuccgugcagcccggcccuaugauugaugucaacacggacuga

SEQ ID NO: 1063 - RNA, 1242 nt, Artificial Sequence
  derived and/or modified CDS sequence (opt5) from MERS-CoV__ALA49865__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacauuggcacaggcccugaggccgcccuccccuuuagagcugugaaggaugggaucgucugggugcaugaagacggagccaccgaugcuccuucuacguucggcacccggaaccccaauaacgacagcgccauuguuacacaauuugcgccggggaccaaacugccuaagaauuuccacaucgagggaacaggcgggaacucccagucuagcucccgcgccagcucuguguccagaaacagcucucgguccagcucucagggaucccgcagcggcaauuccaccagaggcacgucucccgggccuagcggaaucggcgcugucgggggagaucuucuguaucucgaccugcugaaccggcuccaggcccuggaauccggcaaggugaaacaaagccagcccaagguuauuacaaagaaggaugcugccgccgcuaaaaauaagaugcgccauaagagaaccucuacaaaauccuuuaacauggugcaggcguucgggcuucggggacccggcgaccugcagggcaauuuuggggaucuccaacugaacaaacuuggaaccgaggacccuagauggccgcagaucgccgaacuggcucccaccgccagcgccuucaugggcaugucucaguuuaaacucacacaccaaaauaacgaugaccaugggaauccugucuacuuccugcgcuauagcggagcuauuaagcuggaccccaaaaacccuaauuacaacaaguggcucgagcugcuugagcagaauaucgaugccuacaaaacguuucccaagaaggagaaaaagcagaaagcgccgaaggaagaauccaccgaccagaugucugagccucccaaagagcaacgggugcagggcagcauuacacagagaacccgcacacggccuuccgugcagcccgggccuaugaucgaugucaacaccgacuga

SEQ ID NO: 1064 - RNA, 1242 nt, Artificial Sequence
  derived and/or modified CDS sequence (opt5) from MERS-CoV__ALA49909__N
auggccagccccgcugccccuagagcgguguccuucgcugacaacaaugauaucaccaacacaaaucugucucggggccgcgggagaaacccgaagccccgggccgccccuaauaacacggucagcugguacaccggacucacacagcacggcaaaguuccccugaccuuuccucccgggcaaggagugccucuuaaugcuaacuccacaccggcccagaaugcuggcuauuggcgcagacaggaccggaagauuaacaccgggaauggaaucaaacagcuggcgccccgcugguacuucuauuacacaggcaccggcccugaggccgcccuccccuuuagagcugugaaggaugggauugucugggugcaugaacacggagccacggacgcuccuucuaccuucggcacacggaaccccaauaacgauagcgccaucguuacccaauuugcgccggggacaaaacugccuaagaauuuccauauugagggaaccggcgggaacucccagucuagcucccgcgccagcucuguguccagaaacagcucucgguccagcucucagggaucccgcagcggcaauuccacgagaugcacaucucccggcccuagcgggaucggagcugucggcggggaccuucuguaucucgaucugcugaaccggcuccaggcccuggaauccggaaaggugaaacaaagccagcccaagguuaucaccaaaaaggacgcugccgccgcuaaaaauaagaugcgccacaagagaacaucuaccaaauccuuuaacauggugcaggcguucggccuucgggggcccggagaucugcagggcaauuuuggcgaccuccaacugaacaaacuugggaccgaggauccuagauggccgcagauugccgaacuggcucccacagccagcgccuucaugggaaugucucaguuuaaacucacgcaucaaaauaacgacgaucacggcaauccugucuacuuccugcgcuauagcggggcuaucaagcuggaccccaaaaacccuaauuacaacaaguggcucgagcugcuugagcagaauauugacgccuacaaaaccuuucccaagaaggaaaagaagcagaaagcgccgaaggaggaauccacagaucagaugucugagccucccaaagagcaacgggugcagggaagcaucacccagagaacacgcacccggccuuccgugcagcccggcccuaugauugacgucaacacggauuga

SEQ ID NO: 1065 - RNA, 4062 nt, Artificial Sequence
  derived and/or modified CDS sequence (opt6) from MERS-CoV__AFS88936__S
augauacacaguguauuucuccuaauguuuuuauuaaccccaacagaaaguuauguagaugugggaccagauagcguaaaaucagccuguaucgaagucgacauacaacaaacuuucuuugacaaaacauggccccgccccauagauguuucuaaagcagauggaauaaucuauccacaaggacgaacuuauucaaauaucacaauuacuuaucaaggacucuuuccauaucaaggagaccauggcgacauguacguuuacagcgcaggccaugcaacagguacaacgccacaaaaauuguucguagcaaacuauucucaggacgugaaacaauuugcuaauggauucguagucagaauaggugcggcagcaaauaguacagguaccguaauaauaucacccuccacaagugcuaccauaagaaaaauauacccagccuuuaugcuaggauccucaguaggaaauuuuucagauggaaagauggggagauucuuuaaucacacacucguuuuauugccagacgguugcggcaccuuacugcgagcauuuuacuguauauuagaaccucgcuccggaaaccacugucccgcagguaacucauacaccaguuucgcaacauaccauacaccagcaacagauugcucugauggaaacuauaaucguaacgcaucccuuaacucauuuaaagaauacuuuaauuuacgcaauugcaccuuuauguacacuuauaauauuacagaagaugaaauauuagaaugguuuggcaucacacaaacagcucaggguguccaucuauuuucaucucgcuacguagaucuuuauggagguaacauguuccaauuugcaacccuacccguauaugacacuauaaaauauuacucuauaaucccacauucaauaaggucaauucaaucagaucgaaaagcaugggcagccuucuauguauauaaacuucaaccuuuaacauucuuacuagauuucucaguagacggauacauuagacgagcuauugacugcgguuuuaaugaucuaagccaacuacauugcucauacgaaucguucgacgucgaaucuggaguuuacucaguuucaucuuucgaagcuaaaccaucaggaucuguaguagaacaagccgaaggcguugaaugugauuuuucaccccuucuaucugguacaccuccacaagucuauaacuucaaacgcuuagucuucacaaauuguaacuauaauuuaacaaaauuacuaagucuauuuucaguaaaugauuuuacauguagucaaauuuccccugcugcaauagccagcaacugcuacaguucccuaauccuggacuacuucaguuauccucuaucuaugaaaucagaucuuuccguaucaagcgccggucccauaucacaauuuaauuauaaacagagcuuuaguaaccccacauguuuaauacucgcuacaguaccacauaaucuaacgacuauaaccaaaccacuaaaauauagcuauaucaacaaaugcucacgguuauuaucagaugauagaacugaaguuccacaacuuguaaaugcaaaucaauacucacccuguguuucaauagucccaaguaccguaugggaagacggagacuauuacagaaaacaacuaucacccuuagaaggcggcgguuggcugguugcaucuggaucuacuguagcuaugacagaacaauuacaaauggguuucgguauaacaguccaauacggaacugauacaaauucuguaugccccaaacuggaguucgcaaacgacacaaaaaucgcuucccaauuagguaauugcguagaauacucauuauacggcguauccgguagaggcguauuucaaaauuguaccgcagucggaguccggcaacaacgauuuguauaugaugcauaucaaaacuuaguaggauauuauuccgaugaugguaauuacuacuguuuacgagcauguguuucugucccagucaguguaauauacgacaaagaaacgaaaacucaugcuacgcuuuuugguucugucgcuugugaacacauaucgucaacuaugucucaauauucgcgaagcaccagaucaaugcucaagcgacgagacucuacauacggacccuuacaaacaccgguugguuguguacuaggacucgucaauucuucauuauuugucgaagauuguaaacuuccauuaggucaaucacucugugcccuaccugauacaccaaguacguuaacaccccgcucuguaagaaguguaccaggagaaaugcgacuugccuccauagccuuuaaccaccccauccaaguagaucaacuaaauuccaguuauuucaaacuuucaaucccuacuaauuuuucauuuggaguaacgcaagaauacauccaaaccacuauucaaaagguaaccguagacugcaaacaauauguuuguaauggcuuccaaaaaugcgaacaauuacuacgagaauauggacaauuuuguucaaaaauaaaucaagcauuacauggcgcaaaccuuaggcaagaugacucaguacgaaauuuauuugcaucaguaaaaaguucacaaaguucucccauaauacccggauucggaggagacuucaaccuaacauuauuagaaccuguuuccauaagcaccgguucucgcucagcucgauccgcaauugaagauuuauuauucgauaaaguaacuauagcugauccaggauacaugcaagguuaugacgauugcaugcaacaaggaccagcaagugcaagggacuuaauuugcgcacaauauguagcugguuacaaaguccuuccgcccuuaauggacgugaauauggaagcggcauauacaucuucgcuauuaggcucuauagcugguguaggauggacagcaggccugaguucuuucgcugcaauucccuucgcccagaguaucuuuuaucggcuuaacggaguaggaauuacacaacaaguauuauccgaaaaucaaaaacuuauugcaaauaaauucaaucaagcacuaggugccaugcaaacaggcuucacaaccacaaacgaagcauuucaaaaaguucaagacgccguaaauaacaaugcacaagcccugucuaaacucgcauccgaguuaucaaacacauucggggcaauaucagcaaguauuggagauauuauucaacgauuagacguauuagaacaggacgcccaaauagaccgcuuaauuaauggacgucuaacaaccuuaaaugcauucguagcgcaacagcuaguucgcucugaaucagcagcucuaagcgcccaacuagcaaaagauaagguaaacgaauguguaaaagcucaaucaaaacguucaggguucuguggacaagguacccauauaguaucuuuuguugucaaugcaccaaauggauuauauuucaugcauguaggauacuaccccuccaaccauaucgagguagucucugccuacggucuaugcgacgcugcaaauccaacuaauugcauagcaccaguaaacgguuacuucauaaagacuaacaauacacguauuguagaugaauggagcuacacaggauccuccuucuaugcaccugaaccuaucaccucacuuaacacaaaauauguagcaccacaagucacuuaucaaaacauuucuacaaaucuaccaccaccacuauuaggaaauuccacaggaauagauuuccaagaugaauuagaugaguucuuuaaaaacgucagcacaucaauuccgaauuuugguucccuaacccaaauuaacaccacauuacuagauuugacuuaugaaaugcugucacuacaacaaguagucaaagcacuaaaugaaucauacauagaucucaaagaauuaggcaacuauacuuacuauaacaaauggccaugguauauauggcuaggauuuauugcugggcucgucgcauuagcauuauguguuuucuuuaucuuguguuguacagggugcgguaccaacuguaugggcaaacugaaauguaaccgauguugugacagauacgaagaguaugaucuagaaccgcacaaagugcacguccacuaa

SEQ ID NO: 1066 - RNA, 4062 nt, Artificial Sequence
  derived and/or modified CDS sequence (opt6) from MERS-CoV__AFY13307__S
augauacacucuguauuuuugcuaauguuucuccuaaccccaacagaaucauacgucgaugucggcccugauucaguuaaguccgcauguauugaaguugacauucaacaaacauuuuucgacaagacauggccuagaccuauagacguauccaaagcagacggaauuauuuauccacaaggaaggacuuauucuaauauaacaauaacguaccaagguuuguucccuuaccaaggcgaccacggggauauguauguauacucagccggacacgcaaccgguacuacaccccaaaaacuauuuguagcaaauuauucacaagacgucaaacaauuugcaaauggauuugucguaagaauaggagcggcagcaaacucuacaggaacagucauaauuucaccaucaacauccgcaacuauucguaaaaucuauccugcauucauguuagguagcucaguaggaaauuucuccgacgguaaaaugggcagguucuucaaucacacauuaguauuauugccugauggauguggcacccuauuacgcgcguucuauuguauacuagaaccccguagcggaaaccauugcccugccggaaacuccuauaccucguuugcaaccuaucacacaccggcgaccgauugcucggaugguaauuacaaucgcaaugcuucuuuaaauagcuuuaaagaauacuucaauuuacguaacugcacauuuauguauacauacaauauaacugaagaugaaauuuuagaaugguuuggaauaacacaaacagcccaagguguacaucuguuuucaucacgauauguugaucuuuacgguggaaauauguuucaauucgcaacucuuccuguauaugacacaauaaaauacuacucaauuauaccacauagcauccguaguauacaaucugauagaaaggcaugggcagccuucuacguuuacaaacuccagccauuaaccuuucuauuagauuucucagucgauggcuauauuagacgagcuauagauugcgguuucaaugaccuaucacaauuacauuguucauacgaaucauuugauguugaauccgguguuuauucagucucuagcuuugaagcuaaacccucuggcagcgucguagaacaagcagaaggaguagaaugcgauuucucaccuuuauuaucaggaacuccaccccaaguauacaauuuuaaacgauuaguauucaccaauugcaauuacaaucuaacgaaauuacuauccuuauucuccguaaaugauuuuacuuguucucaaaucaguccugcugcuauugcaaguaacuguuacucauccuuaauuuuagacuacuuuaguuaccccuuaagcaugaaaucugaucuaucugucuccuccgcaggaccaauuucacaauucaacuacaaacagucauuuucaaauccuacauguuuaauacuagcaaccgucccccauaaucuuaccaccauuacaaaaccccucaaauauucuuacauaaacaaauguucaagauuccuaucugaugauagaaccgaaguaccacaacuuguuaaugcaaaccaauacucaccuugugugucgaucguucccucuacaguuugggaagacggugacuacuaucgaaaacaacuaucaccauuagagggaggagguugguugguagcuucaggaagcacaguagcaaugacagaacaauuacaaaugggcuuuggaauaacaguacaauauggaacagauacuaacucagucuguccaaaauuagaauuugcuaacgauaccaaaauagcaagccaacuagggaacuguguagaauacagcuuguacggaguaucaggccgcgguguauuccagaacugcaccgcuguaggaguacgacaacaaagguucguauaugacgcuuaccaaaaccuaguaggguacuauucugacgauggaaacuauuauugccucagagcauguguuucugucccaguuuccguuauauaugacaaagaaacaaaaacgcaugcuacacuguucgguucuguagcaugcgagcauaucucuucuacuaugagccaauacagucgaucgaccagaucaaugcuuaaacgccgagacucuacauacggcccucuucaaacuccagucggaugcguacuaggacucgucaauaguagccuguuuguugaagacuguaaacucccacuaggccaaucccuaugugcuuuaccugauacuccaucuacuuuaacgcccagaaguguaagaucaguuccgggugaaaugcgguuagcaucaauugcauuuaaccauccaauucaaguagaccaauuaaauagcucuuauuuuaaacuaucaaucccaacaaauuucucguuuggaguuacacaagaauauauccaaacaacaauacaaaaagucacuguagacuguaaacaauacguuugcaaugguuuccaaaaaugugaacaauuauuacgagaauacggacaauuuuguucgaaaauaaaucaagccuugcauggagcaaauuugagacaagacgauucuguacguaaucucuuugccuccgugaaaaguucucaauccucuccuaucauuccaggauucggcggagauuuuaaccuaacucuauuagaaccuguuucaauuucuaccgguucacguucugccagaucggcaauagaagaccuacuauuugacaagguaacaaucgccgauccaggauauaugcaaggguacgacgacuguaugcaacaaggacccgcuucugcacgagaucucauuugugcucaauaugucgcagguuauaaaguacuaccaccccuaauggauguuaauauggaagcagcauauacauccucccuccuugguagcauagcugguguaggcuggacugcagguuuaucaucuuuugcagcaauaccuuucgcccaaucuaucuuuuaucgacuaaaugggguugguauuacacaacaaguacuuucagaaaaccagaaacuaauagcaaauaaguucaaccaggcacuaggagcuaugcaaacagguuuuaccaccaccaaugaggcuuuucacaagguacaagacgcaguuaauaacaacgcucaggcacuaucuaaauuagcuucagaacuuucaaacaccuucggcgcuauaagugcaucuaucggugauauuauacaaaggcuagacgucuuagaacaggacgcucaaauugacagacuuauaaacggaagacuaacuacucuaaaugcuuuuguagcgcaacaauuaguaagaucagaaucugcagcucuuucagcacagcucgcuaaagauaaaguaaaugaaugugucaaagcccaauccaaaagaucuggcuuuugcggacaaggaacacauauaguuucauuuguuguuaaugccccaaacggcuuauauuuuaugcaugugggauauuacccauccaaccauaucgaaguaguaagugcauauggacuaugcgaugcugcaaacccuacaaauugcauagcuccggucaauggauauuuuauuaaaacaaauaauacccguauaguagaugaauggucauauacuggcucaucauuuuacgcuccagaaccaaucacuucucugaacacuaaauacguagccccacagguaacguaccaaaauauaagcaccaauuuaccaccaccauuacucggaaauucaaccggcaucgauuuccaagaugaacuagaugaauuuuucaagaaugucucuacauccaucccaaauuucggaucuuuaacacaaauuaauacuacgcuccuugaucuaacauaugaaaugcuaucucuccagcaaguaguaaaagcacuuaacgaaucauauauugaucucaaagaauuaggcaauuauaccuauuacaauaaauggccgugguacauaugguugggguucauagcuggauuaguagcccucgccuuaugcguauucuuuauacuuugcuguacuggauguggaacuaacuguaugggaaaauuaaaauguaauagauguugugacagauaugaagaauacgacuuagaaccucauaaaguacauguacacuaa

SEQ ID NO: 1067 - RNA, 4062 nt, Artificial Sequence
  derived and/or modified CDS sequence (opt6) from MERS-CoV__AGH58717__S
augauacacucaguauuuuuacuaauguuucugcuaacuccaacagaaucauacgucgacgucgguccugacucagucaaaucagcauguauagaaguggauauucaacaaacguucuuugauaaaacauggccacggccaauagauguauccaaagcugacggcaucauauacccucaaggcagaacauacuccaacaucacaauuacuuaccagggacuauuuccuuaucaaggugaucauggugacauguauguauauucagcuggacaugcuacuguuacuaccccucaaaaacuauucguagcaaauuauucacaagacguaaaacaauuugcaaauggcuuuguaguuagaauaggagccgcugcaaauagcacagguacaguaauaauaagcccuagcacaagugcaacaauaagaaaaauuuaccccgcauuuauguuaggaucaucuguagguaacuuuuccgaugguaaaaugggacgauucuucaaccacacauuagucuuacuacccgauggcuguggaacacuccuaagagcauucuauugcauauuagaaccacguaguggaaacuacugcccugcagguaauucauauacaaguuucgcaacauaccauacuccugcaacagacugcucugaugggaacuacaacaggaacgcauccuuaaauucuuucaaagaauauuuuaaccuaagaaacugcacauucauguauaccuauaauaucacagaagaugaaauauuggaaugguuuggaauaacacaaacagcucaaggaguacaccuauucucaucuagauauguggaucucuauggugguaauauguuucaauucgcaacacucccugucuacgauacuauaaaauacuacucaauaaucccucauucaauuuuaagcauacagucagacagaaaggcaugggcagcuuucuacgucuacaaguuacagccacucacauuuuuacuggacuucucuguagauggauauauaagacgagcuauagauugcggauucaacgacuuaucccaacuacacugcucuuacgaaucauuugaugucgaaucaggaguuuauucuguauccuccuucgaggccaaaccuucuggauccgucguugaacaagcagaagguguugaaugugauuuuagcccacuccucucuggaacuccaccacaagucuauaauuuuaaaagauuaguauuuaccaauuguaauuacaaccuaacaaaacuucuaucuuuauuuagugucaaugauuuuacaugcucacaaauuuccccugcagcaauagcaucgaauugcuacucuucuuuaauacuagacuacuucucauauccauuaaguaugaaaucugaucuaucagugucaucagcaggaccaauaagccaauuuaauuacaaacaaucguuuucaaauccuacuugccuaauacuugcuaccgucccacacaaccucacaaccauaacaaaaccuuuaaaauacucauacauaaauaaaugcucacgauuauuguccgacgauagaaccgaaguuccccaauuaguuaacgcuaaucaauacuccccaugugucucaauagucccuuccacaguaugggaagauggagauuacuaucguaaacaacuaucaccucucgaaggaggaggauggcucguagcaagcggaucaacagucgcuaugaccgaacaacuccaaaugggcuucgguauaaccguccaauacggaaccgacaccaauucaguuuguccuaaacuugaauuugccaaugauacaaaaauagcaucccaauuaggaaacugcgucgaauacucccuuuacgguguaaguggccguggaguauuucaaaacugcacagcuguugguguucgccaacaacguuuuguauacgaugcauaucaaaaccucguaggauauuacucagacgacggaaauuauuauugucuccgagcuugugucucaguuccuguaucuguaauauacgauaaagaaaccaaaacacacgccacucucuuuggcaguguagcuugcgaacacaucucuuccacaaugucucaauauuccagaaguacaagaucaaugcuaaaacgaagagauucaacauacggaccuuuacaaacaccuguaggaugcguacuuggauuaguaaauucaucuuuguucgucgaggauuguaaacuacccuuaggacaauccuuaugcgcccuacccgacacaccuucgacccuaacaccucgaucaguaagauccguaccaggugaaaugagauuagcaucaauugcuuucaaccaccccauacaaguugaccaacuaaacucauccuauuuuaaacuaucaauaccgacaaacuucuccuuugguguaacccaagaauauauacaaacaacaauccaaaaaguaacaguagacuguaagcaauauguauguaacgguuuccaaaaaugugaacaauuauuaagagaauauggccaauucugcucaaagauaaaucaagcacuacauggugcaaaccucagacaagaugauucaguuagaaaucucuuugccucuguuaaaucaucccaaaguucacccauaauuccugguuuugguggcgauuuuaacuuaacauuguuagaacccguaucgaucuccaccggcucaagaucggcaagaucagccauagaagaucuauuauucgauaaaguaacuauagcagauccaggauauaugcaagguuaugaugacuguaugcaacaaggucccgcuucugccagagauuuaauaugcgcccaauacguagcuggguauaaaguuuuaccaccauuaauggauguaaauauggaagcugcuuacacuucuucucuuuuagggucaauagcuggaguuggauggacagcuggauugucaucauucgcugcuauaccauucgcucaaucuauauucuaccgacugaacggugucggaauaacccaacagguacuuucagaaaaucaaaaacuuaucgcaaauaaauuuaaccaagcacuaggugcaaugcaaacagguuuuacaacaacaaacgaggcauuucaaaaaguccaagacgcaguaaauaauaacgcucaagcacuuucaaaacuagcaucagaacucaguaauacuuucggagcaauuucagccucaauaggcgacauaauacaaagauuagacguacuggaacaagaugcacaaauugaucgauugauaaaugguagauuaacuacauuaaacgcuuucguagcucaacagcuaguccggucagaaagcgcugcauuaagugcacaauuagcaaaagauaaagucaacgaauguguaaaagcacaaagcaaacgcucagguuuuuguggccaagguacgcauauuguuagcuuuguaguuaacgcuccaaacggacuuuauuuuaugcaugugggauauuauccaucaaaccacauagaaguagucucagcauacggacuaugcgacucagccaacccuacaaacugcaucgcgccuguuaacggauacuuuauaaaaacaaauaauacccgaauaguagaugaauggucauacacaggcucgucuuucuacgcccccgaaccaaucaccucacuaaauacaaaauacguagcaccacaaguaacuuaccaaaauauuucaacgaaccucccaccuccauuacuugguaauucuacaggaauugacuuucaagaugaauuagaugaguucuucaaaaacguaucuacaucaauaccuaacuucgggagcuuaacucaaauaaauaccacacuuuuagaucuuacauacgaaaugcugaguuuacaacaagucguaaaagcacuaaacgaauccuauauagaucugaaagaauuagguaacuauacauacuauaauaaauggcccugguacaucugguuaggauucauagccggccuagucgcauuagccuuauguguuuucuuuaucuugugcuguacaggaugcggaaccaauugcaugggaaaacucaaaugcaaucgauguugcgaucguuaugaagaauacgauuuagaaccacauaaaguccacgugcauuaa

SEQ ID NO: 1068 - RNA, 4062 nt, Artificial Sequence
  derived and/or modified CDS sequence (opt6) from MERS-CoV__AGN52936__S
augauucauucugucuuuuuacuaauguuucuacuaacuccuacagaauccuauguugaugucggaccagauucaauaaaaucagcauguauugaagucgacauucaacagacuuucuuugauaaaacuuggccaagaccuauagacguaucuaaagccgacggcauaauuuauccacaaggcagaacauauaguaauauuaccaucacauaccaaggcuuauucccuuaccaaggugaccauggagauauguauguauacuccgcuggccaugcuacagggacaacuccacaaaaacuauucguagcaaauuacucccaagacgucaaacaguucgcaaauggauuuguuguaagaauaggcgcagcagcuaauucaacaggcaccgucaucauuuccccuuccacauccgcuacaauacgaaagauauauccugcauucaugcucggcucaucuguuggcaauuucucugacggaaaaaugggacgauucuuuaaucauacccuaguacuccuacccgaugggugcggcacacuccuaagagccuuuuacugcauacuagaaccaagaaguggaaaccauugccccgccggaaauucuuacacauccuuugcuacauaccacacaccagcuacagauuguucagacggcaacuacaauagaaaugcaucucuaaauucauuuaaagaauauuuuaaccuacgaaacuguacauuuauguauacuuacaauaucacugaagaugaaauuuuagaaugguucggcauaacucaaacagcacaagguguccaucuauuuucaaguagauacguagaucuuuacgguggcaacauguuccaauucgcuacacuaccuguuuacgacacaauuaaauacuacaguauaauuccacauucuauucgaaguauccaaagugaucgcaaagcgugggcagcauuuuauguuuacaaacuacaaccuuuaacauuuuuacuagacuuuucaguagauggauacauacgaagggccauagauugcggauucaaugauuuaucacaguuacauuguucauaugaaucauucgacgucgaaucuggaguuuacucuguuucuucuuucgaggcuaaaccaaguggcagcguaguugaacaagcagaaggaguagaaugcgauuucucccccuuauugucugguaccccaccucaaguauauaacuucaaacgauuaguuuuuacaaauuguaacuacaacuuaacaaaacuacuaucauuauuuucaguuaaugacuucacgugcucccaaaucucuccugcugccauagcaucaaauugcuauucuucacuaauacuugauuauuuuucauauccucucucaaugaaaucagaccuaucaguuucaucggcaggucccauaucccaauucaauuauaagcaaucuuucucuaauccaacaugccuaauauuagcgacaguuccucacaauuuaacuacuauaaccaaaccuuugaaauauucguacauaaauaaauguucuagacuucucucagacgaucguacugaaguaccccagcuaguaaaugcaaaucaauacucaccauguguaagcauaguucccucgacaguuugggaagacggcgauuacuacagaaaacaauugucaccacuagaagguggaggaugguuaguugcaucuggcaguacugucgcuaugaccgaacaauuacaaaugggauuuggaauuaccguacaauaugguaccgauaccaacaguguaugcccaaaacuugaauuugcaaacgacacaaaaauagccucacaacuuggaaauugcgucgaauauucauuauauggaguaucaggacguggcgucuuucaaaauugcaccgcuguuggagucagacaacaacgauucguuuacgaugcauaccaaaaccuagucgguuauuauucagaugauggaaacuacuauugcuuacgagcauguguaucuguaccagucuccguaauauacgacaaagaaaccaaaacacacgcaacccucuucggcaguguagcaugugaacauauauccucuacaaugagucaauacaguagauccacaagaucaaugcuaaagaggagagacuccacuuauggaccauuacaaacacccgugggaugcguacuagguuuaguuaauuccucccuauucguagaagauugcaaacuaccucucggacaaucacuaugcgcacuaccggauacacccaguaccuuaacaccgagguccguuagaucagucccaggagaaaugagacuugcaucaaucgcauuuaaucauccaauacaaguugaccaacuaaauucaucauacuucaaacuuucaauuccuaccaauuuuucguucggagucacccaagaauauauacaaacgacaauacaaaagguaacaguagacuguaagcaauauguaugcaauggauuucaaaaaugcgagcaauuacuuagagaauacggacaauuuuguuccaaaauaaaccaagcauuacacggcgcaaaccuucgacaagacgauucugucagaaaucuauuugcuaguguaaaauccucccagucaagcccaauaauccccggcuuuggaggagauuuuaaucuuacguuauuagaaccuguaucaauaucaacaggaucuagaucugcuagaucagcaauugaagaucuccuguucgauaaaguuacaauagcugauccuggauacaugcaagguuaugacgacugcaugcaacaagguccagcguccgcccgcgauuuaauaugcgcacaauauguugcaggauacaaaguacuuccuccccuaauggaugucaacauggaagcugcguauacaucaucguuauuaggaaguauagcugguguuggcuggaccgcuggauuauccucauuugcugcuaucccuuucgcacaauccauauuuuaccgacuaaauggaguuggaauaacacaacaaguacuaagcgaaaaucaaaaacuaauugcuaauaaauucaaccaagcauuaggcgccaugcagacagguuuuacaacaacaaaugaagcauuccauaaaguccaggaugcaguuaauaauaaugcucaagcucuuucaaaacuagcaucggaauuaaguaauacauuuggagcaauaucagcaagcauaggagauauuauacaaagauuagacguccuugaacaagaugcgcaaauugaucguuuaauaaaugguagacucacaacauuaaaugccuuuguagcccaacaacuuguacguucagagagugcagcauugucggcucaacuagcuaaggauaaaguaaaugaaugcguuaaagcucagagcaaaagaucagguuucuguggucaaggaacacauauuguaucauuuguagugaacgcacccaauggauuauauuuuaugcacguuggauauuauccaucaaaccacauugaagucguuucugcauacggucucugcgaugcagcaaauccuacaaauugcaucgcaccaguaaauggauauuuuauuaaaacaaauaacacacgcauuguagacgaauggucauauaccggaagcuccuucuaugccccagaaccaauuaccuccuuaaacacaaaauaugucgcaccacaagucacauaucagaauaucucaacaaaccuaccuccuccucuauuggguaauagcaccggaauugauuuucaagaugaacucgaugaauuuuucaaaaacgucaguaccuccauacccaacuuuggaaguuuaacacaaauaaauacaacacuuuuagacuuaacauacgaaaugcuaucccuacaacagguaguaaaggcccuuaaugaaaguuauauagaccuuaaagaacuagguaauuacacuuauuacaauaaauggccgugguauaucuggcucggauuuaucgccggucucguagcguuggcccuguguguuuucuuuauuuuaugcuguaccggcuguggcacuaacuguauggguaaacucaaaugcaaucgcugcugugauagauaugaagaauaugaucuagaaccucacaaaguucacguucauuag

SEQ ID NO: 1069 - RNA, 4062 nt, Artificial Sequence
  derived and/or modified CDS sequence (opt6) from MERS-CoV__AGN70951__S
augauacauucuguauuuuuacuaauguuucuccuaacaccuaccgaaaguuacguugacguaggucccgacuccguaaaaucagcuuguauagaaguagacauccaacaaacguucuucgauaaaacuuggccaagacccauugacguauccaaggcagacggaauuauauacccacaaggaaggacauauuccaacaucacaaucaccuaccagggauuauuuccuuaccagggagaccacggugauauguauguauauagcgcuggacaugcuacaggaacaacaccacaaaaauuauucgucgcaaacuacucccaagauguuaagcaauuugcuaauggauuuguuguucgaaucggagcagcagcaaauucuacgggcacagucaucaucucuccaucaacaucugcgacaauuagaaaaauauacccugccuuuaugcuagguucuuccguaggaaauuuuucagacggaaaaaugggccguuucuuuaaucacacucuaguauuguuaccugauggaugcggaacacuuuuacgcgcguucuacugcauacuagaaccacguucgggaaaccacugccccgccggaaauucuuauacuucauuugcuacauaccauacaccagcuacugauugcucagauggcaauuacaaucgaaacgcaagucuaaauucguucaaagaauauuuuaacuuacgaaauugcacuuuuauguacacuuacaauauuacagaggaugaaauccuugaaugguuuggaauaacucaaaccgcgcaaggcguccaucuauuuuccagucguuaugucgaccuauaugguggaaacauguuccaauuugcuacccuaccaguguacgacacuaucaaauacuauucaauuauaccacacucuauacguuccauacaauccgacagaaaagcaugggcagcauuuuauguauauaaacuucaaccacuuacuuuccucuuggauuuuucagucgauggauacauccgcagagccauagauugcgguuuuaaugaucuaucacaauuacauuguucauacgaaucuuuugauguagaaucaggcguguacucagucuccagcuuugaagcuaaaccgucagguuccguaguagaacaagcggaaggagucgaaugugauuuuucgcccuuauuauccgguacaccuccacaagucuauaacuucaaaagacuuguauuuaccaacuguaacuacaauuuaacaaaacuacucucccuuuucagcguaaaugauuuuacguguucacaaauauccccugcagcuauugccucaaacugcuauucaucgcuaauucuagauuacuucucuuauccccuaucaaugaaaucagacuuaucaguuaguagugcaggaccuauaucucaauuuaauuacaaacaaucauuuucaaaccccaccuguuuaauacucgcaaccguuccccacaaccuaacaaccauaacaaaaccucucaaauacucauauauaaauaaaugcaguagacuauuaucggacgacagaacagaaguaccucaauuaguaaaugccaaucaauacucuccauguguaucaauagugccuagcaccgugugggaagauggugauuauuaccgcaagcaauuaucaccauuagaggguggaggauggcucguugcaaguggaucaaccguagccaugacagaacaacuucaaaugggauuugguauuacaguacaauauggaacugacacuaauaguguuuguccaaaauuagaauuugcaaaugacacuaaaaucgcaucacaauugggaaauuguguagaauacagccucuacgguguaucgggcagaggaguauuucaaaauuguacagcagugggaguaaggcaacaaagauuuguuuacgacgcguaccaaaacuuaguaggcuauuauucugacgacggcaacuacuauugucuuagagccuguguuuccguaccuguaucugucauuuacgacaaggaaacaaaaacucaugcaacccuuuuuggaucaguagcaugcgaacauauaucuucuacuaugucucaguacucuagaagcacccgcucaaugcucaaaaggcgagacuccacuuaugguccucuccaaaccccuguagguugcguauuaggauuaguaaacucaucccuauuuguagaagacugcaagcuaccacucggacaaucuuuaugcgccuuaccagauaccccaucaacccuaacuccaagaaguguaagauccguuccaggugaaaugcgacuagcaucuaucgcuuuuaaucacccuauacaaguagaccaacugaacucaagcuauuuuaaauuaucuauacccacaaauuuuucauuuggagugacucaggaauacauacagaccacaauucaaaagguaacaguagacuguaaacaauaugucuguaauggguuucaaaaaugcgaacaacuucugagagaauacggucaauucuguucaaaaauaaaucaagcucuacacggagcuaaccuuagacaagacgacucagugcgcaaccuauuugccucagucaaauccucucaaucuucaccaauaauaccaggauuuggcggagacuucaaucuuacauuguuagaaccuguauccauaucaacaggaagucgaucugcacgcucugcaauagaagaccuccuauuugacaaaguaaccauugcugacccaggauacaugcagggauaugacgacuguaugcaacaaggcccugccucugcccgagaucuaauaugugcccaauaugucgccggauauaaaguuuuacccccacuuauggauguuaacauggaagcagcguacacuuccagucucuuaggcuccauagcgggagucggauggaccgcuggucuuagcaguuucgcagcuauccccuucgcucaaaguauauuuuaccgcuuaaauggcguugguauaacccaacaaguucuuucugaaaaccaaaaacuuaucgcuaacaaauuuaaucaagcccuaggagcuaugcagacagguuucacaacaacaaacgaggcuuuucgaaaaguacaagaugcagugaacaacaaugcacaagcacucucuaaacucgccucagaauuaucuaacacauucggagcaauaucagccucaauaggcgauauuauacaacgacuugauguucuugaacaagacgcacaaauugaucgacuaauuaacggccggcucacaacuuugaacgcauuuguugcacaacaauuaguacgaucugaaucugcugcccuuuccgcccaacucgcaaaagacaaaguaaaugagugugucaaagcacagucaaaacgaucaggcuuuuguggccaagggacccacauaguaucuuuuguaguuaacgcacccaauggacuuuauuuuaugcacgucggauacuacccauccaaucauauagaaguggugucugcauaugggcuuugcgacgcagccaauccuacaaauuguaucgcacccguuaacggauauuuuaucaaaacuaacaauacucgaauuguugacgaauggucauacacugguaguagcuucuacgcaccagaaccaauaaccagcuuaaacacaaaauauguagcaccucaugucacuuaucaaaauauaucaacuaauuuaccaccuccuuuacuaggcaauagcacagggaucgacuuucaagacgaauuagaugaauuuuucaaaaacguuucuacaaguauaccaaacuucggauccuuaacacaaauaaacacaacacucuuagacuuaacuuacgaaaugcuuagucuacaacaagucguaaaagcccuaaacgaaucauauauugaucuaaaagaauuaggaaauuacacuuauuauaacaaauggccaugguacauuugguugggauuuauugccggacuugucgcccuagcucucugcgucuucuuuauauuauguugcacuggcugugguacaaacugcaugggaaagcucaaaugcaaccgauguugugaccguuaugaagaauaugaccuagaaccacauaaaguacacguucauuaa

SEQ ID NO: 1070 - RNA, 4062 nt, Artificial Sequence
  derived and/or modified CDS sequence (opt6) from MERS-CoV__AGV08408__S
augauucacagcguauuccuguuaauguuuuuacugacuccaacagaaucauauguugaugucggaccagauuccgugaaaagugcaugcaucgaaguugacauacaacaaacauucuuugacaaaaccuggccuagacccauagacguaaguaaggcagaugguauuauuuacccgcaaggucgaacguauaguaacauaacaauaacguaccaaggucuauuuccuuaccaaggagaucauggugauauguacguauacuccgcaggucaugccacugguacaacaccucaaaaauuauuuguggccaacuacucacaagaugucaagcaauuugcuaauggcuucguaguaagaauuggagcugccgccaacuccacagguaccguuauaauaagucccaguacaagugcaacaauccgcaaaauauauccagcauuuaugcuagguaguucuguagguaauuucucagacgggaaaaugggacguuucuucaaccacacacuugugcuccucccagauggauguggcacauuacugagagcauucuauugcauccuagagcccagaucaggaaaccauuguccggcggguaacuccuacacaucuuucgcaacguaccacacaccagccacugauugcuccgauggaaauuacaaucgaaaugcaucacuaaacucauuuaaagaauacuucaaucucagaaauuguacauucauguauacauacaauauaacugaagaugaaauacuugaaugguuuggcauuacacaaacagcucaaggcguccaccucuuuucaucuagauacguagauuuauauggaggaaacauguuccaauuugcgacuuuaccagucuaugauacaauaaaauauuauagcauuaucccccacucaauuagaucaauucaaucagaucguaaggcuugggcagcauuuuauguauacaaacuacaaccucuaacuuuucuacuagacuuuaguguugacggauacauccgucgugcuauagauuguggauuuaaugaucuaagccaauuacauugcucuuacgaaucauucgauguagaaucgggaguauauucaguaucuucuuucgaagcaaaaccuagugguagcguugucgaacaagcagaagguguugaaugcgacuuuagcccccuuuuauccggaacuccuccucaaguauauaacuuuaaacgacuuguuuucacaaauuguaauuauaaccuuacgaaauuacuaucacucuucuccguuaaugauuuuaccugcucacaaauuucacccgcugcuaucgcuaguaauuguuauaguucauuaauacuagacuacuuuucauacccacuauccaugaaaucugaucuaucaguuucaagcgcuggucccauaagccaauuuaauuauaaacaauccuucucaaacccaacaugccuuauccucgcgacuguuccucacaaucuaacaacgauaacaaaaccgcuaaaauacuccuauauaaacaaauguucaagacuccuaucuggagaucgcacugaggugccacaacuugucaacgcuaaccaauauuccccuuguguaucuauuguaccgucgacugucugggaagacggagacuauuaccgcaaacaauuaucaccgcuagaaggaggaggauggcuaguagcuucagguucaacaguugcaaugacagaacaauugcaaauggguuuuggaaucacaguccaauaugguacagauacaaauucuguuugcccaaaacuugaauuugcuaacgauacaaaaauagcaagucaauuaggcaauugcgucgaauauucucuuuacggagucaguggacgaggugucuuccaaaauuguacagcugucggaguuagacaacagagguuuguauaugacgccuaccaaaaucucguuggauauuacucagaugacggaaacuauuauugucuaagggccuguguaucagucccaguuucuguaauauaugauaaagaaacaaagacacaugcaacuuuguuugguaguguagcaugcgaacacauaucuucuacaaugagccaguauucuagaucaacaagaaguauguuaaaaagaagagacucaaccuauggaccacuccaaacacccgucgggugcguccuaggguuaguuaauucaagucuuuuuguggaagauuguaaauuaccgcucgggcaaucauuaugugccuuaccggauacaccaaguacgcuuaccccaagaucaguuagaucgguacccggagaaaugagacuugcuaguauagcuuuuaaucauccaauucaaguugaucaacuaaauucaucauacuuuaaacuuucaauacccacaaacuucucuuuuggagucacacaagaauacauccagacuaccauacaaaaaguuacaguagacuguaagcaauacgugugcaauggauuucaaaaaugugaacaauuauuaagagaauauggacaauuuuguucaaaaaucaaucaagcucuccauggagcuaaccuucggcaagaugacucuguacgaaaccuguuugcuaguguaaaauccucacaaucuaguccgaucauacccggauuuggaggagacuucaaccuuacucuacuugaaccaguaagcauaucuaccggaucucgcucagcacgaucugcgaucgaagauuuacuauuugacaaaguuacaauugcugauccuggauauaugcaaggauaugacgacugcaugcaacaaggaccugcaucagccagagauuuaauuugcgcccaauacgucgcugguuauaaaguucucccuccucuaauggacguuaauauggaagcagcauauacaaguucacuuuuaggcaguauagcaggaguaggauggacagcagguuuaaguuccuucgcugccauaccauucgcucaaaguauuuucuaucgguuaaacggaguagguauuacucaacaaguccuaucugaaaaccagaaauuaauugccaacaaauuuaaucaagcucuaggugccaugcagaccggauuuacuacgacaaacgaggcuuucagaaaaguucaagacgcaguaaauaacaaugcacaggccuuaucaaaacuagcaagugaacuaucaaauaccuuuggugcaauuucagcgucaauaggggacauuauacaacgauuagauguccuugaacaagaugcacagauagaucgacuaaucaacgguagauugacaacauuaaacgcauucguagcccaacagcuagucagaucugaaucugcagcacuuuccgcacaacuagcuaaagauaaaguaaacgaauguguaaaggcgcaaucaaaaagaucaggcuuuuguggacaagguacacauauagucucauuugucguaaaugcaccuaacggacuauacuucaugcauguagguuacuauccaucaaaucacauagaagucguauccgcauacggccuaugcgacgcugcaaauccaacaaauuguauagcaccagucaacggcuacuuuauaaaaacaaauaauacacguauuguugaugaauggagcuauaccggcucaucuuuuuaugcacccgaaccuaucacaagccuaaauacgaaauacguagcaccccaagucacauaccaaaauauaaguaccaauuuaccgccaccucuacuugguaacucaacaggcauugacuuccaagaugaacuagacgaauuuuucaaaaacguguccacuuccauacccaauuuuggaucuuuaacacaaauaaauacuacauuacuugauuuaacauacgaaauguuauccuuacaacaaguggucaaagcacuaaacgaaagcuauauagacuuaaaagaacucggaaacuacaccuauuacaacaaauggccaugguacauuugguuaggauucauugcaggauugguagcccuagcucuuugcguuuucuuuauacuaugcugcacuggaugcggaacaaauuguaugggaaaacuuaaaugcaauagaugcugcgauagauaugaggaauaugauuuagaaccacauaaaguacauguacacuaa

SEQ ID NO: 1071 - RNA, 4062 nt, Artificial Sequence
  derived and/or modified CDS sequence (opt6) from MERS-CoV__AGV08455__S
augauucacuccguauuucuccugauguuuuuauuaacaccaacugaauccuauguagacguagggccugacuccguaaaaagcgcguguaucgagguagacauacagcaaacauucuuugauaaaacauggcccagaccaauagauguaucaaaagccgauggaauuauauauccucaaggaagaaccuauucaaauauuacuauaacauaccaagguuuauucccauaccaaggagaccauggugauauguauguauacucagcaggccacgcgacagguaccacaccccaaaaauuauuugucgcuaauuauucccaagaugucaaacaguuugcaaaugguuucguugugcgaauaggcgcagcagcaaacucaacaggaaccguaauaauaagcccaucaacaucagccacuauucgaaaaauuuacccugcuuuuauguuagguucaucagucgguaauuucuccuacggaaagaugggacgcuuuuucaaucacacacuuguauuauuaccagauggcuguggaacuuuauuacgugcauucuauugcauccuugaaccaagauccggaaaucauugucccgcaggaaacaguuacacaucuuuugcuacauaccauaccccugcgacugacugcagugauggaaauuauaauagaaaugcuucacucaacucuuucaaagaauauuucaaccucaggaauugcacauuuauguauacauacaauaucacagaagaugaaauauuagaaugguuuggcauaacacaaacagcacaaggaguccauuuauuuucaucacgauaugucgaucuauauggcgguaacauguuccaauucgcaacacuccccgucuacgauaccauaaaauauuauucaaucaucccucauaguauacgaucuauacaaucagacagaaaagcaugggcugcuuucuauguauauaaauuacagccacuaacguuuuuauuagacuucucuguugacgguuauauaagacgagcaauagauugugguuucaacgaucuuucccaguugcacugcagcuaugaaucauuugauguugagucaggcguguauucaguuucgucguuugaagccaaaccaucaggaaguguuguagaacaggcugaaggggucgaaugcgauuucucuccacuacuaucuggaacaccaccgcaaguuuacaacuuuaaaagacucguauuuacuaacuguaacuauaaccuaacaaaacuccucucacuauuuucuguaaaugauuuuacuuguagucaaauaagcccagcagccaucgcaucuaacugcuauuccucauuaauacuagauuauuucuccuauccacucagcaugaaaucugacuuaagcguaucaagcgcugggccaauaagccaauuuaauuacaaacaaaguuucagcaacccaaccugccuaauucuagcuacagucccacauaacuuaacuaccauaacaaaaccgcugaaauacucguacauaaacaaauguucccgauuacuuagcgaugauagaacggaagucccucaacuuguaaacgcuaaucaauauucacccugugugucaauaguacccucuaccguaugggaagauggugauuacuacagaaaacaauuaucgccuuuagaagggggagguuggcuugucgcaucagguaguacaguagccaugaccgaacaauuacaaauggguuucggaaucacaguucaguauggaacagauaccaauuccguaugcccaaaauuagaauuugcaaaugauacaaaaauugcaucucaauuggguaauugcguugaauacucacuuuaugguguaucgggacgcggcguauuucaaaauuguaccgcaguaggcguuagacaacaacguuucgucuaugacgccuaucaaaaucucguaggguacuacagugaugauggaaauuauuauugccucagagcaugugucucaguaccaguaucaguaaucuacgauaaagaaacuaaaacccaugccacacuauuugguucuguagcuugugaacacauauccucaacuaugagucaauacucccguaguaccagauccaugcuuaaacgaagagauucgacauauggcccauuacagacuccaguaggauguguauuaggacucguuaacucuucauuauucguugaagauugcaaacuaccacuaggacaaucuuuaugugcauugcccgauacuccaucaacuuuaacgccaagaucaguucgaucuguccccggagagaugaggcucgcaucuauagcuuuuaaucauccaauucaaguagaccaacuaaauagcucuuauuuuaaacuuagcaucccuacaaacuucucauuuggcguaacacaagaguacauacaaacaacgauccaaaaaguaacuguagacuguaaacaauacguaugcaacggauuccaaaaaugcgaacaacuccuuagagaauauggucaauucugcucaaaaauuaaucaagcccuucacggugcuaaucuaagacaagaugauucuguaagaaaccucuucgccucuguaaaaucuucucaaagcagcccaaucauuccuggcuucggaggugacuuuaaucugacacuacuagaaccugucuccaucucaaccgguucuagauccgcuagaucugccaucgaagacuuauuauuugauaaaguuaccauagcugaccccggauacaugcaaggauaugacgacugcaugcaacaagguccagcaucugcacgugaucuuauaugcgcucaauauguagcuggcuauaaaguccugccuccauuaauggauguaaauauggaagcagcuuauaccaguucacuucuaggaucaauugcgggcguaggcuggacagccggccuuucaucuuuugcagcaauucccuuugcacaaagcauuuucuauagacuaaacggcguuggaauuacucagcaagucuugucagaaaaccaaaaacuuauugcgaacaaauucaaccaagcacuaggcgcaaugcaaacaggcuuuacgacuacaaacgaagcauuccgaaaaguccaagacgcagucaauaacaacgcacaagcacuaucaaaacuagcaucugaacuuaguaacacuuucggcgcuauaucagcaucaauuggagauauaauacaaagauuagacguacucgaacaagaugcacaaauagauagauugaucaaugguagauuaacaacucuaaacgcauuuguagcgcaacaauuagucagguccgaaucagcugcucuaucggcacaauuagcuaaggauaaaguaaaugaaugcguuaaagcacaaagcaaacguucgggauuuugcggacaagggacacauauuguaucauuuguuguuaaugcaccuaauggcuuauauuuuaugcacguuggguacuauccgaguaaucauauagaaguaguaucagcuuauggcuuaugugaugcagcaaauccgacaaauugcauagcaccuguuaacgguuauuuuauuaaaacuaauaauacucgaaucguagacgaaugguccuacaccggcagcucuuuuuacgcaccagaaccaauaacaaguuuaaauacaaaauacguggcaccacaagucaccuaucaaaacauaucaaccaacuuaccacccccacuauuaggaaacucaacagguauagauuuucaagaugaacuagaugaauuuuucaaaaacguuaguaccuccauaccgaauuucggaucucucacccaaauaaauacaacucuucuagaccuaacuuaugaaauguuaucacuucaacaaguaguaaaagccuuaaacgaaaguuacauagaucuaaaagaguuaggaaacuauacauauuauaauaaguggccuugguacaucuggcuaggcuuuaucgcaggccuaguagcucucgcacucugcguauucuuuauacucugcuguaccggaugcggcacaaauuguaugggaaaacugaaaugcaaccguuguugugacagauaugaagaauaugaucucgaaccucauaaaguucauguccacuga

SEQ ID NO: 1072 - RNA, 4062 nt, Artificial Sequence
  derived and/or modified CDS sequence (opt6) from MERS-CoV__AGV08467__S
augauccacucuguauucuuauuaauguuccuacuaacaccaaccgaaucuuaugucgacguaggucccgauucagucaaaucugccugcauagaagucgauauacaacaaaccuucuucgauaagaccuggcccaggccaauagacguauccaaagcagaugguauaauauacccucagggaagaaccuauucaaacaucacaauuacauaccaaggacucuuuccauaccaaggagaucauggagauauguauguauauucggcaggacacgcaacugguacuacaccacaaaaacuuuuuguugcuaacuacucccaagacguaaaacaauuugcaaauggauuuguuguccgcauaggagcugcugcaaauucaacuggaacaguaauuauuucaccaucuaccucugcuacgauacgcaaaauuuaccccgcauuuauguugggaucaucugucgguaacuuuucagauggaaaaaugggaagauucuucaaccauacauugguacuacucccugauggcuguggaacucuacuucgagcauuuuacuguauacuggaacccagauccgguaaccauuguccagcagguaacucauacacaaguuucgccacauaucacacuccugccaccgacugcuccgacgguaauuacaaucgaaaugccucacuaaacuccuucaaagaauacuuuaaccugcgcaacugcacuuuuauguauacuuacaacauuaccgaagacgaaauucuagaaugguuugguauaacucaaacagcacaaggaguacauuuauucucaagccgauacguugaccuauauggaggcaauauguuccaauucgcaacacugccaguauaugauacaaucaaauauuacuccaucauuccccauucuauuagaucaauacaaucugacagaaaagcaugggcagcuuucuacguuuacaaguuacaaccucucacauucuuacuagacuuuucaguagauggauauauucgccgagccauagacugcggauucaacgaccuaucacaauuacacuguuccuacgaaucauuugauguagaaucaggaguuuauucaguguccaguuucgaagcuaaaccaagcggaucagucguagaacaagcugaggguguagaaugugauuucucaccauuacuaucugguacaccuccccaagucuauaauuucaaacgccuagucuucacuaauuguaauuauaaucucacuaaacuacuuaguuuauucucugugaaugauuuuacaugcucucagaucucacccgcagcaauagccucgaauugcuacagcucacuaauacuugauuacuuuaguuacccauuaucaaugaaaucagacuuaucuguuucaagcgcaggucccauaagucaauuuaacuauaaacaaucauuuucuaauccaaccugucuaauacucgcaacuguuccucauaaucucacaacuauaacaaaaccgcucaaauauucauacauaaacaaaugcucucgauuauuaucagaugaccguacagaaguaccacaauuaguaaaugcaaaccaauacucaccguguguaagcauuguuccaucaaccguuugggaggacggagacuacuaucguaaacaacuaucaccccuugaggguggcggaugguuaguugcgucuggauccaccguggccaugaccgaacaacuucaaaugggauuugguaucacuguacaauauggaacagacaccaauucugucuguccuaaacuugaauuugcaaaugacacaaaaauagcaucucaauuagguaauugcguagaauacucacuguauggcguaagugguagaggcguauuucaaaauugcaccgcuguaggagucaggcaacaaagauuugucuaugacgcuuaccaaaacuuaguagguuauuacucggaugauggaaacuauuauugccuacgugccugugucucaguacccguauccgucauuuacgacaaagaaacuaaaacacaugcaacucuauuugggucuguugcuugugaacauauaucuuccacuaugucacaauacuccagaagcacgagaucuaugcucaaaagacgugacucaaccuacgggccacuucagacacccguuggauguguacucggauuggucaacucaucauuauuuguagaagauugcaaauuaccacuuggccaaagucucugugcacuacccgacacaccaaguaccuuaacgcccagaucaguuagaucgguaccuggagaaaugaggcuagcaucaauagcauuuaaccaccccauacaagucgaccaacuaaacaguucauacuuuaaacuaucaauaccuaccaauuucagcuuuggcguaacacaagaauauauacaaacaacaauacaaaaaguuacuguagauugcaaacaauauguauguaacggcuuucaaaaaugugaacaacuucuccgagaauauggucaauucuguagcaaaauuaaucaagcucuacacggagcaaaucuaagacaggaugauucaguacgaaaucuuuuugccucaguaaaaaguucacaaucuucuccuaucauuccugguuuugguggagauuucaaucuaacccuuuuagaaccuguuagcauuucaacgggcaguagauccgcuagaucagccauagaggaccucuuauuugauaaaguaacaauagcagacccaggauacaugcaaggcuaugacgacugcaugcaacaaggccccgcaagcgcucgggacuuaauaugugcucaauauguugcagguuauaaagugcuaccuccauuaauggauguuaauauggaagcagcauauacuucuucauuacuugguucaauagccggagucggauggacagcuggauuaucaucuuuugcagcgauaccuuucgcacaaucaaucuucuauagacucaauggaguuggaauaacucaacaaguauuaucagaaaaccaaaaacuaaucgcaaacaaauuuaaucaagcccuaggagccaugcaaacugguuucacuacaacaaaugaagcauuuaggaaaguucaagaugcaguuaacaacaacgcacaagcgcucucaaaacuagcuuccgaacuaucaaauacguucggcgcuaucucugcuaguaucggagacauaauacagagauuagacguacuagaacaagacgcucaaauagauagacuuauaaacggacgauuaacaacucuuaaugcuuucgucgcacaacaacuuguacguagugaguccgcagccuuaagugcucaguuagcaaaagauaaaguaaaugaaugugucaaagcacaauccaaacgaucuggcuuuugcggccaaggaacacauaucguaaguuucguuguaaacgcgccaaauggccucuacuuuaugcaugucgguuacuaucccucgaaucauauagaaguuguaucagcauaugguuuaugugaugcagcaaauccaacaaacugcauagccccaguaaaugguuacuucauuaaaacaaacaauacacgaauagucgacgaauggagcuauacaggaucuucauucuaugcaccugaaccgauuacaucucuaaacaccaaguauguagccccacaaguaacauaucaaaacaucaguaccaaccuuccaccaccacuacucggaaacuccauuggcaucgacuuucaagaugaacuagaugaauuuuucaaaaacguaaguacuagcauaccaaacuuuggaucuuuaacucaaauuaauacaacucuauuagacuuaacauacgaaaugcuuaguuuacaacaagucguuaaagcauuaaacgaaucauacauugaccucaaagaacucggcaacuacacauacuauaauaaauggccaugguauauauggcuaggauuuaucgccggccucguggcucuugcccuaugcguuuucuuuauucucuguuguacaggauguggcacgaauugcaugggaaaauuaaaaugcaauagguguugcgaucguuaugaagaauacgacuuagaaccccacaaaguacacguucauuga

SEQ ID NO: 1073 - RNA, 4062 nt, Artificial Sequence
  derived and/or modified CDS sequence (opt6) from MERS-CoV__AGV08492__S
augauacacagcguuuucuuauuaauguuucucuuaaccccuacagaauccuauguagauguuggaccagauuccgucaaauccgcgugcauagaagucgacauccaacaaacauucuuugauaaaacauggccucgaccuauugauguaucaaaagcugauggaauuauuuacccucagggcagaacauauucaaauauuacaauuacauaccaaggccuuuuuccuuaucaaggagaccacggagauauguacguauauuccgcuggccaugcuacgggcacaacuccucagaaacuauucgucgcaaacuacucacaggaugucaaacaauuugcuaacgguuuuguaguccgaauaggagcugcagcuaacucgacaggaaccguaaucauuagcccuagcacauccgcuacaauacgaaaaaucuaccccgcauuuaugcucggaagcucgguuggcaauuucucugauggcaaaaugggucgauuuuucaaucauacucuagucuuauuaccagauggcugcggaacauuauuacgugcauuuuauugcauacuagaacccagaucaggaaaccauuguccagcugguaauucauacaccaguuuugccacuuaucacacuccugcuacagacuguucugauggaaacuauaacagaaaugccucacucaauagcuucaaagaauauuuuaaccucagaaauuguaccuucauguacaccuacaauaucacagaagaugaaauacucgaaugguuuggcauaacgcaaaccgcacaaggcguccauuuauuuaguucacgcuacgucgaucuauauggcggcaacauguuucaauucgcuacccuacccguuuacgauaccauaaaauauuauuccauuauaccucacaguauucgaucaauacaauccgaucgaaaggcuugggccgcuuuuuacguauauaaacuccaaccacucacuuuccuacuugauuucucuguagacgguuauauaagacgcgccauagauugcggauucaacgacuuaucacaacuacauuguucauacgaaucauuugacguagaaucaggugucuauucuguuucaucauuugaagcaaaaccaucuggauccguaguugagcaagcagaaggcgucgaaugugacuuuucaccuuuacuaucaggaacaccuccacaaguauauaauuuuaagcgauuggucuucacaaauuguaacuacaacuuaacaaaauuacuuucacuauuuagcgucaaugauuucacaugcucucaaaucucaccagcagcaauagccagcaacuguuacucuucacuaauuuuagacuauuuuucauauccccuuucgaugaaaucagaccuaucaguuagcagugcaggaccaaucucacaguuuaauuauaaacaaucauuuucaaauccaacaugccuaauucuggcaacuguuccccacaacuuaaccacaaucacaaaaccacucaaguacagcuacauuaacaaauguucaagauuacucucugaugauaggacagaaguuccccagcuaguaaaugcaaaccaauacuccccaugcgucucuauaguacccucuacagugugggaagauggcgacuacuacagaaaacaacuuuccccauuagaaggaggcggauggcuuguagcaucuggauccacuguagcaaugacugaacaacuucaaauggguuuuggaauaacuguacaauacggaacggauacaaauucaguuugcccaaaauuagaguucgcaaaugauacaaaaauagcaucacaacuagguaacugcguagaauacucuuuguaugguguaucugggagaggugucuuucaaaauugcacugcuguuggaguuaggcaacaaagauuuguauacgacgcuuaccaaaauuuaguuggcuacuauagugaugacggaaauuauuacugccuccgugcauguguaucuguacccguuuccguuaucuacgauaaagaaacuaaaacacaugcgacacucuuugggucagucgccugugaacauauaucuucuacuaugucccaauacagcagauccacacggucgaugcucaagagacgagauuccaccuaugggccacuccaaacaccaguagguuguguguuaggucucguaaacucaucucuauuuguagaagacugcaaacuaccacuaggacaaagucuaugcgcuuuaccagauacaccaucuacacucacaccccgauccguccguucaguccccggagaaaugcgcuuagcauccauugcuuucaaccauccuauacaaguggaccagcuaaauucaucguacuuuaaacuaucaauuccaacuaauuucucuuuugguguuacccaagaauacauucaaacuacaauacagaaaguaaccgucgacuguaaacaauacguauguaacggauuucaaaaaugcgaacaacuuuuacgcgaauacggccaauuuuguucgaaaauaaaccaagcucugcauggagccaaccuaagacaagaugacucaguccgaaacuuauuugcaucagucaaauccagccaauccucaccaauuaucccaggauucggaggagauuuuaaucuaacucuuuuagaaccuguuucaauaucuacaggaucccgaagcgccagaucagcaauugaagaucuacucuuugacaaaguaacaauagcagauccaggcuauaugcaaggcuaugacgauugcaugcaacaagggcccgcaucugcucgagacuuaauaugcgcacaauauguugcuggauauaaaguacuaccaccacuaauggauguaaacauggaagcugcauacacaucaucucuccuuggaucaauugcuggugucggcuggaccgcgggauuauccaguuuugccgcaaucccuuucgcacaaucuauauuuuaucgucuuaacggaguaggaauuacacaacaaguccuuucagaaaaccagaaacuuauagccaauaaauucaaccaagcucuuggcgcaaugcagacgggcuuuacaacaacaaaugaagcauuucgaaaaguacaagaugcagucaauaauaacgcacaagcacuaucuaaacuggccucugaauuaucuaauacuuuuggagcaaucucugcaucaauaggugauauaauucaacguuuagauguccuagaacaagaugcucaaaucgauagauuaauaaacgggagauuaacuacauuaaacgcuuuugucucacaacaacuuguaagaucagaaucugcagcacuuucagcacaauuagccaaagauaaaguaaaugaauguguaaaagcacaaucuaagagaucagguuucugcggucaaggaacucauaucguaucuuuuguagucaacgcuccaaauggacuuuauuuuaugcacguaggauauuaccccucuaaccacaucgaagucguuuccgcauacggacuaugcgaugcugcuaaccccacaaacugcaucgcaccaguaaacggauacuuuauaaaaacaaacaacacucgaauugucgacgaauggucauauacuggaucaucguuuuaugcaccugaacccaucacaaguuuaaauacuaaauacguagcaccucauguaacauaccaaaacauaucaacuaaccuaccaccuccacuucuaggaaauuccacuggaauugacuuucaggacgaauuagacgaauuuuucaaaaauguuaguacaaguauuccuaauuuugggaguuuaacucaaaucaauacaacucuauuagaccuaaccuacgaaauguuaaguuuacaacaaguugucaaagccuuaaacgaaucauacaucgaucuuaaagaacucggaaacuauacuuauuacaauaaauggccaugguacauauggcuagguuuuauugcuggccuuguagcauuagcccucuguguauucuuuauucuaugcugcacuggaugcgggacaaauugcaugggcaaacuuaaauguaaucgcuguugcgauagauaugaagaauaugauuuagaaccacacaaaguacacguccacuag

SEQ ID NO: 1074 - RNA, 4062 nt, Artificial Sequence
  derived and/or modified CDS sequence (opt6) from MERS-CoV__AGV08584__S
augauucauucuguuuuucuacuaauguucuuauuaacaccaacugaaagcuauguagauguugguccagauucuguuaaaucagccuguauugaaguugacauucaacaaacauucuuugacaaaaccuggcccagacccaucgaugugucaaaggcugacgguauaaucuacccucaaggaagaacauauucuaacauuacaauaaccuaucaaggauuauucccuuaccaaggagaccauggagauauguacguuuacagugcuggucacgcuacaggcaccacaccccaaaaacuauucguagcgaacuauucacaagacguuaaacaauucgcaaacgguuuuguggucagaaucggagcggcagcuaauuccacggguacaguaauuauaagcccaucaacuucugcuacaauaagaaagauuuacccugcauuuauguugggaagcuccguaggaaacuuuucagacgguaagaugggccgauucuuuaaccacacauuaguauuacuuccugacggcuguggaacauuauuacgcgcauucuacuguauucuugaacccagaucaggaaaccacugcccugcuggaaauagcuauacaucauucgcaacauaccauacaccagcgacagacuguagcgauggaaacuacaauagaaaugcaucccuaaauagcuuuaaagaauauuuuaacuuacgaaacuguacguucauguauacauacaauauaacugaagacgaaauacucgaaugguucggaauaacacaaaccgcacaaggaguccaucuauuuagcucaagauacguagaucuauacgguggcaauauguuccaauuugcaacauuaccaguauaugauacaauaaaauauuacucaauuauuccacacucuauccguucaauacagagcgaccgaaaagcaugggcagcauucuacguauauaaacuacagcccuuaacauuucuuuuagacuuuuccgucgacgguuauauuagacgagcuauagauugcggcuucaaugauuuaagccaacuucauuguucauacgagagcuucgacguagaaucuggugucuauucaguaucauccuucgaagcuaaaccuucaggguccguuguagaacaagcagaagguguagaaugcgauuucucaccacucuuaucaggcaccccaccacaaguauauaacuuuaaaagauuaguauuuacaaacuguaauuacaauuuaacaaaacucuuaucuuuguucagcguaaacgauuucacuuguucccaaauauccccagcugcaauugcaucuaacuguuacaguagcuuaauuuuagacuacuuuaguuauccccuuucgaugaagucagacuugucgguaucaucagcugguccaaucucacaauuuaacuacaaacagucuuuuucuaacccaacaugucucauacuugcuacaguuccccauaaccucaccaccauaacuaaaccauuaaaauauucuuacaucaacaaaugcucacgauuacuaucugacgaccgaacugaaguaccacaauuaguuaaugcuaaucaauacaguccaugcgucagcauaguaccaaguaccgcuugggaagacggcgauuauuauagaaagcaacuuucaccuuuagaaggaggugguuggcuaguagcuaguggauccacaguugcaaugacagaacaacuucaaaugggcuuugggauaaccguacaauauggaacagacacaaacagugucuguccaaaacuagaguucgcaaacgacaccaaaauagcuucacaauuaggcaacuguguagaauauucacucuaugguguaucuggcagagguguuuuucaaaauugcacugcaguuggcguccgacaacaaagauuuguauaugaugccuaucaaaauuuaguugguuacuauucagaugauggcaacuauuacugccuacgugcaugugucuccguaccaguuucaguaauuuaugacaaagaaacuaaaacacaugccaccuuauuuggcucaguugcuugugaacacauuucuucaacuaugagucaauacagucgaucaacaagaagcauguuaaaacgcagagacaguacguaugguccgcuucaaacacccguaggaugcguccuuggccuaguuaacagcuccuuauuuguagaagauugcaaacucccguuagggcaaucacuuugcgccuuaccagauacaccuucaacuuuaaccccuagaucuguaagaucaguaccaggcgaaaugcgguuagcaucuauagcauuuaaccacccaauucaaguagaucaacuaaauucuaguuauuuuaaauuauccauuccaacuaauuucucauuuggcguaacccaagaauauauccaaacuaccauacaaaaaguaacuguagacuguaagcaguacgucuguaauggcuuccaaaaaugcgaacaguuacuucgugaauauggucaauucuguucaaaaaucaaucaagcacuucauggagcuaaucugagacaagacgauucuguucgcaauuuguuugcuuccguaaaaaguucucaaucaucccccauaauuccuggauucgguggugauuuuaaucuaacacuauuggaacccguuucaauuucaacaggcagcagauccgcaagaucugcaauagaagaccuauuauuugauaagguaacgauagcugaucccggguauaugcaaggauaugaugacuguaugcaacaaggacccgccucugcaagagaucuaaucugugcacaauacguugccgguuauaaaguguuaccuccauuaauggauguuaauauggaagcggcuuauacaucaucacuauuaggauccauagcagggguuggcuggacugccggacucaguucauuugcugccauacccuuugcucaauccauauuuuaccgauuaaacggcguaggcauaacacaacagguucuuuccgaaaaucaaaaauuaauagcaaauaaauuuaaucaagcacuaggcgcaaugcagacuggauucacuacuacaaaugaagcauucagaaaaguucaagacgcuguuaauaacaaugcacaagcacuaaguaaacucgccuccgaacuaucuaauaccuucggggcaauaucugcauccauuggagacauaauacaaagauuagauguuuuagaacaagacgcccaaauagaucgauugaucaauggccgauuaacaacauuaaaugccuuuguugcacaacaacucguuagaucugaauccgcugcccuuagugcacagcuagcaaaagacaaaguaaaugaauguguaaaagcacaaucaaagcgaucaggauuuuguggacaaggaacacauauaguuucuuucgucgucaacgcuccuaauggacuguacuuuaugcacgucgguuauuaucccucuaaucauauagaaguaguaucggcauauggucuuugcgacgccgcaaacccaacaaacuguauugccccaguuaacggguauuucauaaaaaccaacaauacacgaaucgucgacgaauggaguuauaccggauccucuuuuuacgccccagaaccuauuacuucccuaaauacuaaauacguugcaccgcaaguaacguaccaaaacauuucaaccaaccuacccccaccauuauuaggaaacagcaccgguaucgauuuccaagaugaacuugaugaguucuucaaaaacguaucaacuuccauuccgaauuucggaucucuaacacaaauuaacacuacucuacuagaucuuacauaugaaauguuaagucuacaacaagugguaaaagcgcuaaaugaaucauacauagauuuaaaagaauuagguaacuacacauauuauaacaaauggccuugguauauauggcucgguuuuauagcaggauuaguugcauuagcucuuuguguauucuucauuuuaugcuguacuggcugcggaaccaauuguaugggaaaacuaaaauguaauagauguugugaucgcuacgaagaguacgaucuagaaccacauaaaguucauguacacuaa

SEQ ID NO: 1075 - RNA, 4062 nt, Artificial Sequence
  derived and/or modified CDS sequence (opt6) from MERS-CoV__AHB33326__S
augauucacuccguuuuccucuuaauguuuuuauuaaccccaaccgaaagcuacguagauguuggaccagauucuguaaaaucggccugcauagaagucgauauucaacaaacauucuucgacaaaacauggccuagaccaauagauguuucaaaagcagacggaauaauauauccucaagguagaacuuacaguaauaucacuauaacauaccaagggcuuuucccguaccaaggggaccauggugauauguacguuuauucagcaggccaugccacuggaacaacaccacaaaaacuuuucguagcgaauuauucacaagauguaaaacaguuugcuaaugguuuugucgucagaauaggagcagcggcauauaguacugguacggucaucauaucacccucaacaagcgcaacaauucguaaaauauaucccgcuuuuauguuaggaucuucaguaggcaauuuuagcgauggaaaaaugggccguuucuucaaucauacucuaguucuacuaccugauggcuguggaacacuacugagagcguucuacuguaucuuggaaccacguaguggaaaccauugcccagcagguaauucuuauacaucauuugcaaccuaucacacuccugcaacugauuguucagacggaaauuacaacagaaacgcuagccuaaauuccuucaaagaauauuuuaaucuacgcaacugcacauucauguauacuuauaauauuaccgaagaugaaauccucgaaugguucggcauaacgcaaacugcacaagguguacauuuauuuuccagcagauauguagaucucuaugguggaaauauguuccaauucgcuacuuugccugucuacgauaccauuaaauauuauagcauaaucccccauucaauacguucuauccaaagcgaucgaaaggcuugggccgcauucuauguauacaaauuacaaccacuuacauuucuguuagacuuuucuguugacggcuacauaagacgagcaauagauugcgguuucaaugaucuuucucaacuccauugcucauaugagucuuucgauguagaauccggagucuauucagucucaaguuuugaagccaaaccaucuggcagugugguagaacaagcugagggagucgaaugcgacuuuucaccauuauuaucaggcacucccccacaagucuacaauuucaaaagauuaguuuucacaaauuguaauuauaaucuaacuaaacuccuaucuuuauucagcguaaacgauuucacauguucucaaauauccccugcugcaauugcaucuaacuguuacucuucacucauauuagauuacuuuaguuauccacuaagcaugaaauccgacuuaagcguaaguucugcaggaccaauaucacaauuuaauuauaagcaaucuuuuucaaacccaaccugcuuaauucuugccacaguuccccauaaccuuacuacaauaaccaaaccguuaaaauacucauacauuaauaaauguucacgauuacuaucagaugaccguacagaaguaccucaauuaguuaacgcgaaucaguauaguccaugugucuccauaguaccuucaacagucugggaagauggagacuacuauagaaaacaacucagcccacuggaaggaggcgguuggcuugucgcuucugguucaacaguugcaaugacggaacaauuacaaaugggauuuggaauaacuguccaauacgguacagacacaaacuccguaugcccaaaguuggaauuugcuaacgacacgaaaauagcaucccaauuagguaauugugucgaauauucucuauauggagucucuggaaggggcguauuccaaaauuguacugcuguaggugucagacaacaacguuuuguuuaugacgcauaccaaaaccuagugggauauuauuccgaugauggaaauuauuacuguuuacgugcuuguguuucaguacccgucagcguaaucuacgauaaagaaacaaagacccaugcuacauuguuuggaucagucgcaugugaacacauuucauccaccaugucacaauacucucguuccacaagaucuauguuaaaaagaagagauucaacauauggaccacuucaaacacccgucggcugcgucuuaggacuuguaaauucaaguuuauucgucgaagauuguaaguuaccauuaggucaaagccuaugcgcucuacccgauacuccaucaacuuuaacuccaagaucagucagaucaguaccaggagaaaugagauuagccuccauugcuuucaaccauccuauacaagucgaccaauuaaauucaaguuauuucaaacuauccauacccacuaacuuuucuuucggaguuacucaagaauauauucaaaccacaauacaaaaaguaacugucgauuguaaacaauauguauguaauggauuucaaaaaugcgaacaacuauuaagagaauauggacaauuuuguuccaaaauuaaucaagcauuacacggagcaaaucuaagacaagacgauucaguuagaaaucucuucgcuuccguaaaaucaucacaaucauccccuauuauaccaggauucgguggugauuuuaaucuaacuuuacucgaaccugucuccaucucuacaggaucaagauccgcuagaucugcaauugaggauuuauuauuugacaagguaacuauagcugaccccggauacaugcaaggcuaugacgacuguaugcaucaaggaccugcauccgcgcgcgauuuaauuugugcacaauaugucgcaggauacaaaguccuuccaccccugauggauguaaacauggaagcugcauauacaucaucuuuauuaggaucaauugcuggcguaggcuggacugccggucucaguucauucgcagcaauaccuuuugcgcaaucaauauucuacagacucaacgguguuggaauaacacaacaagucuuaucagaaaaucaaaaacuuauagcaaacaaauuuaaccaagcauuaggagccaugcaaacaggguucaccacuacaaaugaagcauuucgcaaaguacaagaugccguaaauaacaaugcacaagcucugagcaaauuagcaucugaacuaucaaauacauucggugcgauuuccgcaaguauaggcgauauaauucagcgucuagaugugcuagaacaagaugcacaaauagacagauuaauuaacggaagauuaacuacauuaaaugcauuuguagcucagcaacuuguucgaucagaaucagcagcauuaucugcgcaacuagcaaaagacaaaguaaacgaaugugucaaagcacaaucaaagcguucaggauucuguggacaagguacucauaucguaucauuuguaguaaaugcuccaaacggucuauacuuuaugcauguagguuauuacccaucuaaucauauugaaguaguuagcgcauacggacucugugacgcagcuaacccgacaaauuguauugcaccugucaacggauauuuuauaaagacaaacaacacucgcauaguagacgaauggaguuacaccggcucaucuuucuacucccccgaaccaauaacuucuuuaaacacuaaauacguugccccucaaguaacuuaucagaauauaucaacaaauuuaccuccaccuuuacuagguaauuccacuggcauugacuuccaagaugaacuagaugaguucuuuaaaaacgugucuacauccauaccaaacuuuggcucucugacccaaaucaauaccacuuuacucgaucuuaccuaugaaaugcucucacuacaacaaguaguaaaagcacuaaacgaaucuuacauagacuugaaagaauuaggcaauuauacauacuauaauaaauggccuugguauauuugguuaggguuuauagccggucuaguggcauuagcacuauguguauucuuuauuuuguguuguacaggauguggaacaaacuguaugggaaaacuuaaauguaauagaugcugugauagauaugaagaauacgaccuagaaccucauaaaguacauguacauuag

SEQ ID NO: 1076 - RNA, 4062 nt, Artificial Sequence
  derived and/or modified CDS sequence (opt6) from MERS-CoV__AHC74088__S
augauacauucagucuucuuacuaauguuccuacuaacaccaaccgaaucuuauguagauguuggccccgauuccguaaaaucagcuuguauagaaguugacauucaacaaacauuuuucgauaaaacguggcccagacccauagaugugucaaaagcugacggaauaaucuacccccaagggcggacguauucgaauauaacuauaacauaucaaggacuguucccauaucaaggagaccacggggauauguauguauacucugcaggucacgcaaccggaacaacaccacagaagcuauuuguugcaaauuacucacaagauguuaaacaauucgcaaauggcuuuguaguucgcauuggugcagcugcaaacucuacgggaacaguuauaauaucuccgucaacuagcgcaacaauacgaaagaucuauccagccuucauguuaggcucaucugucggcaauuuuuccgauggcaaaaugggacgcuucuuuaaucauacacucguuuuauuaccagacggauguggaacacuucuacgggcauuuuacuguauccuugaaccacggucuggcaaccacuguccagccggaaauuccuauaccucauucgcuacuuaucacacaccagcuacagauugcucagauggcaauuacaauagaaacgcaucccucaauucuuuuaaagaauacuuuaacuuacgaaacugcacauucauguauacuuacaauauuacagaggacgaaauacuagaaugguucggaauuacccaaaccgcacaagguguucaccuauuuucaucacgauauguugaucuuuacggaggaaacauguuccaauucgccacacuuccaguguaugacacaauaaaauauuauuccaucauaccacacuccauuagaucaauacaaucagacaggaaggcuugggcagcauuuuauguauauaaauuacaaccucucacauuuuugcuugauuucuccgucgacggauacauucguagagcaauugauugcggauucaacgauuuaagucaacuacauugcucuuacgaauccuuugauguagaaagcggcgucuauucaguaucgucguuugaagcaaaaccaucugguaguguaguugaacaagcagaagguguagaaugugauuuuagcccuuuacuaucaggaacaccaccccaaguauacaauuuuaaacguuuaguauuuacaaauuguaauuauaaccuaacaaaacuucuuucacucuucuccguaaaugauuuuacuugcucacaaauauccccagccgccaucgccucaaacugcuacucaucacuuauacuugauuauuucaguuauccacuaucaaugaaaucugaucucaguguuaguuucgcaggacccaucucccaauucaacuacaaacaaucuuucucaaacccuacaugccuaauucuagcuacaguaccccauaacuuaacuacaaucacaaaaccacuuaaguacagcuacaucaacaaaugcucacgauuacuaagugacgaccggacagaagugccucagcuaguaaacgcuaaccaauauaguccuuguguaucaauagucccaucuacagucugggaagacggagauuauuaucgaaaacaacuaucaccacuugaggguggugggugguuagucgccagcggaucaacuguagcuaugacugaacaacuacaaaugggauuugguauaacaguacaauauggaacagacacaaauucaguuuguccaaaauuggaauuugcuaaugacacaaaaauagcaucccaauuagguaauugcguugaauauucacuauauggcguaucggguagaggcguuuuccaaaauuguacagccguaggcguacgacaacaaagauucguuuaugacgcauaccaaaaucuugugggauauuauucagacgacggcaacuauuauugucuaagagcaugcguaucuguaccuguuuccguaauauacgacaaagaaaccaagacacaugcuacucuguuuggaagcgucgcaugugaacacaucaguucuacuaugagccaauacuccagaucaacaaggucaaugcuaaaaagacgugauucuacuuacggaccucuacaaaccccgguaggaugcgucuuagguuuagugaacuccucccuuuucguagaagauugcaaauuaccuuuaggacaaucauuaugugcacucccagacacuccaaguacccuuacaccuaggucuguaagaagcgucccgggcgaaaugagacuagcaucuauagcauucaaccauccuauacaagucgaccaacuaaauaguucauacuucaaacuaucaauaccaaccaacuucagcuuuggcguuacacaagaauacauacaaaccacaauacaaaagguuaccguagauuguaaacaauauguaugcaacggauuucaaaaaugcgaacagcuacuccgagaauacggccaguucugcucuaagauaaaccaagcucuacauggagcaaaucuccgacaagaugauucuguaagaaacuuauuugcaucaguuaagaguagucaaucauccccaauaauuccuggauucggaggcgauuucaacuuaacauuauuagaaccuguaucaaucucuaccggcucaagaucagcaagaucagcuauugaagaccucuuauuugauaaagugaccauugcagauccaggauauaugcagggcuacgacgacuguaugcaacaaggcccagcgucugcaagagaccuuauuugcgcucaguauguggcaggauauaaaguacuaccuccauuaauggaugucaacauggaagcugcauauacuucaucacuauuaggaucgauagcaggaguuggcuggacagccggauugagcagcuucgcugcuauuccauuugcccaaucaauuuucuacagacucaacggaguagggauaacucaacaaguacugagugaaaaucaaaaacuaauagcaaacaaauuuaaucaagcacuuggggcuaugcaaacaggguuuacaacuacaaacgaagcauucagaaaaguucaagaugcaguaaacaacaaugcacaagcgcuaucuaaacuugcaucugaauuauccaacacuuucggagcaauuucggcaucuaucggagacauaauucaaagauuagacguuuuagagcaagacgcacagauugaccgccuaauaaacggucgucuuacgacccucaaugcuuuuguagcucaacaacucguacgauccgaguccgcagcauuauccgcacaauuagccaaggauaaaguaaacgaaugcgucaaagcacaaagcaaacgaaguggauuuugcggacaagguacacauaucguaucauucguuguaaacgcuccuaacggauuguacuucaugcauguaggcuacuacccuucgaaucauauagaagucguuuccgcuuauggacuaugcgaugcagcgaacccaacaaacuguaucgccccaguaaacggauacuuuauaaaaaccaacaacacacggauaguagaugaauggucuuauaccggaagcaguuucuaugccccugaaccaaucacaucauuaaauacaaaauaugucgcaccgcaaguaacauaccagaacauaucaacaaacuugccaccaccccucuuagguaauuccacaggcauagacuuucaagaugaacuagaugaauuuuucaaaaauguaucaacaagcauuccuaauuuuggaaguuuaacacaaauaaauaccacucuucucgaucuuacuuacgaaaugcuaucgcuucaacaagugguuaaagcauuaaacgaguccuacaucgaucucaaagaacuuggcaauuauacuuacuacaauaaauggccaugguauaucugguuagguuuuauugcaggauuaguagcucuagcauuauguguuuucuuuauauuauguugcacaggaugugggacaaauuguaugggaaaacuaaaaugcaaccgauguugugauagauaugaagaguaugaccuugagccucauaaaguacauguucacuaa

SEQ ID NO: 1077 - RNA, 4062 nt, Artificial Sequence
  derived and/or modified CDS sequence (opt6) from MERS-CoV__AHI48528__S
augauacacucaguguucuuacucauguuccuacucaccccuacagaaucauacguagauguuggaccugacucaguuaaaucugcuuguauagaaguagacauacaacaaacuuucuucgacaaaacuuggccaagaccaaucgauguaucuaaagcagaugggauuauuuauccccaagguagaacauacucuaauauaacgauaacuuaccaaggccuauucccauaucaaggagaucauggcgauauguauguauacuccgcuggccaugcuaccgggacaacaccacaaaaacuauuuguagccaacuauucccaagacguuaaacaauucgccaacggauuugucguccguauuggugcugcagcaaacucaacagguaccgucaucauuucaccaagcacaucagcuacuauacgaaaaaucuauccggcuuuuaugcugggcucaucugucggaaauuucucagaugguaaaaugggaagauuuuucaaccacacauuaguauuacucccugacggauguggaacccuacuaagagcuuuuuauuguauacucgaaccucgaucugguaaucacugucccgcugguaauucuuauacaucuuucgcaacauaucauacaccagcgaccgauugcuccgacgguaauuauaauaggaaugcaucuuuaaauucauuuaaagaguauuuuaaucugcggaauuguaccuuuauguacacauauaacauuacagaagaugagauauuagaaugguuuggaauaacucaaacagcucagggaguacacuuauucagcucgcguuacguagaucuguaugguggaaauauguuccaauucgccacacucccaguauaugauacgauuaaauacuauucuaucauaccacacucuaucagaucaauacaaucagaucgaaaagccugggcugccuuuuauguauacaaacuacaaccucuuaccuuccuacuagauuucagcguugauggauauauaagacgagcaauagacugcgguuucaaugaccucucacaacuucauuguucguaugaaucauuugauguugaaagcggaguguauucuguaagcucuuuugaagcaaaaccuagcgggucgguugucgaacaagccgaaggcgucgaaugugacuucuccccauuacucucaggcaccccuccgcaaguauauaacuucaaacgacucguuuucacaaauugcaauuauaaccuuaccaaacuacuuucacucuuuuccguuaacgauuucacuuguagucaaaucuccccacccgcaauagcaaguaauuguuauucuagucuaauauuggauuauuuuucuuauccucuuucuaugaaaucagaccuaucagucuccucugcuggccccauaucacaguucaacuauaaacaaaguuuuucuaaccccacaugcuuaauucuuguaacugucccacauaaucucacuacaaucacuaaaccauugaaauauucuuacauaaacaaaugcucacgacuauugucagaugacagaacggaaguaccacaacuuguuaacgcaaaccaauauucaccaugcguuuccauaguaccaucaacuguaugggaagauggagacuauuauagaaaacaguuaucaccucuagaagguggcgguuggcuagucgcaucagguucuacaguagcaaugacugagcaacuacaaaugggauucgggauaaccguacaauauggaacagacacgaacuccguaugucccaagcuggaauuugcaaacgacacaaaaauugccagucaacucggaaacugcguagaauacucucuauaugguguauccgguagagggguauuccaaaauugcacagcaguaggaguaagacaacaaagauucguauacgacgcauaucaaaauuuaguagguuauuacucagaugacggaaauuauuauugccuacgagcaugcgucucgguucccguaagcgugaucuacgauaaagaaacaaaaacacaugcuacccuauuuggaucaguugccugugaacauauaagcucaacuaugagucaauauuccaggagcacccgaucaauguuaaaacgucgagauucuacauauggaccucugcaaaccccagucggaugcguauuagguuuaguaaauucaucccucuuuguggaagacuguaaacuccccuuaggccaaucucuaugugcauuacccgauacacccagcacauuaacaccgagaucaguccggucuguucccggggaaaugagguuagcaucaaucgcuuucaaucauccaauacaagucgaucaacucaauucuaguuauuuuaaacuuaguaucccaacaaauuucucauucggaguaacacaagaauauauacaaacaacgauacaaaaaguaacuguagauugcaaacaauauguaugcaacggcuuucaaaaaugcgaacaacuucuucgagaauacggccaguuuuguagcaaaauuaaucaagcacuucacggagccaaccuaagacaggacgacucaguuagaaauuuauuugcuucugucaaaucuucacaaagcucuccaauaauaccaggcuuuggaggagacuucaaccuuacacuuuuagaacccguauccauuaguaccggaucacguucagcccgcagcgcgauagaagaccuccuauuugacaaagucacaauugcagaccccggcuacaugcaagguuacgacgacugcaugcaacaaggaccagcaucagccagagaucuuaucugcgcacaauaugucgcgggauauaaaguccucccuccacuaauggacguaaacauggaagccgcuuauacuagcucacuucugggauccauagcuggugugggcuggaccgcagguuuaagcagcuucgccgcaauuccauuugcgcaaucaaucuucuaucgccuuaacggaguagguauaacucaacaaguacucagcgaaaaccaaaaacugauagcaaacaaauuuaaucaagccuuaggcgcaaugcagacuggcuuuaccacuacuaaugaagcauucagaaaaguacaagacgcuguaaauaauaaugcccaggcuuuaagcaaacuagcuucugaacuaaguaacaccuuuggcgcuauaagugcaucaauaggugauauaauacaaagauuagacguacucgaacaagaugcgcaaaucgaccguuuaauuaauggacgacuaacuacauuaaaugcguuugucgcacaacagcuugucagauccgagagcgcagcucuaagugcacagcuagccaaagauaaagugaaugaauguguuaaggcacaaucaaaaagaucaggauucugcggacaagguacgcacauaguaucuuuuguagucaaugcuccuaauggacuuuacuucaugcauguuggauauuaucccuccaaccauauagaaguaguaagugccuauggacugugcgaugcagcaaaccccacaaauuguauugcacccguaaauggauacuucaucaaaaccaacaacacucgcaucgucgaugaauggucuuauacaggcaguucauuuuaugccccugaaccuauuacaucuuuaaacacaaaauauguagcaccacaaguaacuuaucaaaauauaucaacaaaucuacccccucccuuguuaggaaauucaacuggaauugauuuucaagaugaacuugaugaguucuuuaaaaacguuucuacuagcauaccaaauuucggaucuuuaacacagauaaacaccacacuacuagaucuuacauacgaaaugcuaucauuacaacaagucguaaaagcucuaaaugaaucauauauagaucugaaagaacucggaaauuacaccuacuauaauaaauggccaugguauauauggcuagguuucauagcuggccuaguugcauuagcauuaugcguuuucuuuauacuauguuguacaggauguggaacuaauuguauggguaaauuaaaaugcaauaggugcugugauagauacgaagaauacgauuuagaaccucacaaagugcauguacacuaa

SEQ ID NO: 1078 - RNA, 4062 nt, Artificial Sequence
  derived and/or modified CDS sequence (opt6) from MERS-CoV__AHI48550__S
augauucauucaguauuucuccuaauguucuuacuaacuccuacagaaaguuacguagacgucggcccugauucugucaaaucggccuguauagaaguugauauacaacaaacuuucuuugauaaaaccuggccccgacccauagacguuucaaaagcagaugguauaauauauccccaaggacguaccuauucuaauauuacuauaacauaucaaggcuuauuuccauaucaaggagaucauggagauauguauguauacuccgcuggacacgcaacaggaaccacaccucaaaaacucuucguagcaaauuauucucaagauguaaaacaauucgcaaaugguuuugucguaagaauuggugcagcugcaaacucaacuggaacagucauaauuucuccuuccacaucugcaaccauaagaaaaauuuaccccgcuuuuaugcuaggguccuccgugggaaacuuuucagacgguaaaaugggacgguucuucaaucacacauuaguauuacucccugacggaugcggaacacuucuccgagcuuuuuacuguauacuagaaccaagaucuggaaaccacuguccugcaggaaauuccuacacuucuuucgccaccuaucauaccccagccacagauuguuccgauggaaauuacaauagaaacgccuccuuaaacucauucaaagaauauuuuaaucuaagaaauugcacauuuauguauacauauaauauaacagaagaugaaauucuugaaugguuuggaauaacacaaacagcacaaggcguacauuuauuuucaucuagauacguagaccuguacggugguaauauguuccaauucgcgacacuuccaguauacgacaccauaaaauauuauucuaucauaccccauagcauacgaucuauacaaucagauagaaaagccugggccgcuuucuauguuuauaaauuacaaccacucacguuccuacuggauuuuuccguugauggauauauaagacgagcuauugacugcggguuuaaugacuuaucccaacuacacugcucguacgaaaguuucgacgucgaaagcgguguauauuccgucucaucauucgaagcuaaacccucagguucuguaguagaacaagcugagggcguagaaugugauuucucaccacugcucucagguacaccuccucaaguauacaacuucaaacgauuaguauuuacuaacugcaauuauaacuuaacaaaauuacucucccuauuuagcgucaaugacuucaccuguucucaaauauccccugcugccauugcaucuaauuguuauuccucccuuauauuggacuauuuuagcuacccccuuucaaugaaaagugaucuaucagucucuucagcaggaccgauaucucaauuuaacuauaaacaaaguuucucaaauccgacuuguuuaauccuagcgaccguaccccauaauuuaacgacaaucacaaaaccucuaaaauauucauacauaaauaaguguucuagauuauuaucugaugacagaaccgaaguaccacagcuuguuaacgccaaccaauacucaccaugcguaucaauaguaccuucuacagucugggaagauggagacuauuaccgaaagcaauuauccccauuggagggcggaggaugguuaguugccucaggaucaacaguggccaugacagaacaacuacaaaugggauucggaauuacuguucaguauggaacagauaccaauuccguauguccaaaacucgaguucgcuaacgacaccaaaauugccucacaacuagggaacuguguagaauacagcuuauacggaguaucaggaagaggugucuuucagaacugcacagcaguuggaguaagacagcaaagauucguuuacgaugcuuaucaaaaccuagucggauacuauagugacgacgggaauuacuacugccuacgagcauguguuucuguaccaguaagugucaucuacgauaaagaaaccaaaacccaugccacguuauucggaucaguagcuugcgaacacauauccucaacaaugucccaauacucgcguucaacucgaucgauguuaaaacgacgagacaguacauaugguccacuccaaacaccagucggcuguguacuuggacuuguaaacuccucacuuuuuguagaagauuguaaacuuccacuaggccaaucgcucugcgcacuuccugacacucccucaacauuaacucccagaucaguaagaagcguacccggagaaaugagacucgcaaguauagcauuuaaucauccaauucagguugaccaacucaauucuucuuacuuuaaauuaucuauaccaacaaauuuuagcuuuggaguuacccaagaauauauccaaaccacaauucaaaaaguaaccgucgauuguaaacaauauguaugcaacgguuuccaaaaaugugaacaauuacuaagagaauaugggcaauuuuguagcaaaauaaaucaagcucuccauggagccaaucuaagacaagacgacucuguucgaaaccucuuugcaagcgucaaaucaucccaaaguucuccuauaaucccaggcuucgguggugauuuuaaucucacacuauuggaaccaguauccauuagcaccggaucacgcucagcaagauccgcaauagaggaucuacuauucgauaaagugacuauugcagauccaggcuauaugcaaggcuaugaugauuguaugcaacaagggccugcaucugcucgcgauuuaauaugugcucaauauguugcaggauacaaaguucuucccccauuaauggacgucaauauggaagccgcuuauacgucaucuuuacuuggcuccaucgcaggaguaggcuggacugccggauuaagcucauuugcagcaauaccauuugcgcaauccauauucuaccgauuaaacgguguaggaauuacccaacaaguccugagugagaaucaaaagcucauugcaaacaaauuuaaccaagcucucggggcaaugcaaaccggcuuuacaaccacaaaugaagccuuccauaaaguacaagacgccguuaauaacaaugcccaagcacuaaguaaacuagcgucagaauuauccaacacauuuggcgcaauauccgcaaguauaggagauauuauacagagacuagauguauuagaacaagaugcacaaauagaccgacuaauuaaugguagacuuacgacacuuaaugcuuucguagcacaacaauugguucgcucagaaucagcagcacuaagcgcgcaacuagccaaagacaagguuaaugaaugugucaaagcucaaucuaaacguucaggauuuuguggccaagguacacauauuguuucuuuugucguaaacgccccaaacggauuauacuucaugcauguaggcuauuacccgucaaaucacaucgaagucguaagcgcauaugguuuaugcgacgcagccaauccuaccaacugcaucgcccccguaaauggcuacuucaucaagaccaauaauacccguauagucgacgaauggagcuauacagguucaucauucuacgccccugaaccaauaacuucgcuaaauacaaaauacguagcaccccaaguaacauaucagaauaucuccacuaaccuuccuccaccauuauuagguaacagcacaggaauagauuuccaagacgagcucgaugaguucuucaaaaaugucaguacaucaauuccaaacuucggcucacuuacacaaauuaacacgacauuauuagaucucacauaugaaauguuaucauuacaacaggugguuaaagcauuaaacgaauccuauauagauuuaaaagaauuaggcaauuacaccuacuacaacaaauggccaugguacaucuggcuaggguuuauugcagggcuaguagcccuugcucucugcgucuucuuuauccuuugcuguaccgguugcggaaccaacuguaugggcaagcuaaaaugcaaucgauguugugauagauacgaagaauacgauuuacaaccacacaaagugcacguccauuga

SEQ ID NO: 1079 - RNA, 4062 nt, Artificial Sequence
  derived and/or modified CDS sequence (opt6) from MERS-CoV__AHI48583__S
augauacacuccguauuucuccuaauguuccuucucacaccuacagaaucauauguugacguagguccugacucaguuaaaucugcauguauagaaguugauauccaacaaacauucuuugauaaaaccuggccuaggccgaucgauguauucaaagcagauggcauaaucuacccacaggguagaacauauagcaacauaacuaucaccuaucaaggacucuucccuuaucaaggagaccauggcgauauguaugucuauucagcaggccacgccacagguacuacaccacaaaaauuauuugucgcaaauuacucccaagacguaaagcaguucgcuaauggauucgucguaagaauaggugcugccgcaaauuccacuggaacaguaauaauuucgccaaguaccagugcuacaauucgaaaaauuuaucccgcauuuaugcuagggucuucaguagguaauuucagcgaugggaagaugggacgcuuuuucaaccacacacuuguccuucuaccagacggaugugguacacuccuccgcgcuuucuacuguauuuuagaaccuagaagcgguaaucauugcccagcagggaacucauacaccucuuucgccacauaccauacacccgcaaccgacuguucugacggcaacuacaauagaaacgccucacucaacaguuucaaagaauauuuuaauuugagaaauuguacauucauguacacuuauaauauaacugaagaugagauauuagaaugguuuggaaucacacaaacagcccaaggaguccacuuguuuucaucccgcuauguugaccuauacgguggaaacauguuucaauucgcaacccuaccgguauacgacacaaucaaauacuauaguauuauaccacauucaauaagaaguauucaaucagacagaaaggcuugggcagccuuuuauguuuacaaacuacaaccuuugacauuuuuauuggauuuuuccguagaugguuauauaagacgugcaauagacugcgguuucaaugacuuaagccaacuacauuguucauacgaaucauuugauguagaaagugguguauacucgguaucaucauuugaagcaaaaccaucagguucuguaguagaacaagccgaaggagucgaaugcgauuucucaccccuauuauccggaacacccccucaaguuuauaauuuuaaacgucuagucuuuaccaacuguaauuauaacuugacgaaacuacugucuuuauuuucuguuaaugauuucacauguucacaaauuucgccagcggcaauugcuucaaauuguuacuccucauugauacuagauuacuuuucauauccauuaucaaugaaaagcgauuuaagugucucuucugccgggccaauaucucaauuuaacuacaaacaaucuuuuagcaaucccaccugucugauucuagcaacuguaccacauaacuuaacaacaauaacaaaaccccucaaauauucauacauaaauaaaugcucaagacuauuauccgacgaucguacagaaguaccacagcuaguaaaugcgaaucaauacucuccauguguuucuauaguuccaucuacuguaugggaagacggugauuauuacagaaaacaauuaaguccacuugaaggcggugguugguuaguggcaucugguucuacaguagcaaugacagaacaacuacaaaugggauucggcauaacaguacaauacggaaccgacacuaacuccgucuguccaaaauuggaauuugcaaaugauacuaaaauugcaucucaacucggcaacugugucgaguauaguuuauacggugucaguggaagaggaguauuccaaaacugcacagcaguaggcgugcgucaacaaagauuuguauacgaugcuuaccaaaaccuggucggcuauuauucagaugacggaaauuacuacuguuuacgugcauguguaaguguaccaguuucagucauauacgauaaagaaacaaaaacacaugccacgcuuuuugguagcgucgcuugcgaacacauaucaucaacgaugagucaauacagcagaucuacucguaguaugcuaaaaagacgagauaguacauacggaccccuacaaacgcccguaggauguguacucggauuaguaaacuccucacuuuuuguagaagauuguaaacuaccccuaggccaaucucuaugugcacuaccugauacaccuuccaccuuaacaccuaggaguguucgauccguccccggagagaugcgcuuagcaucuaucgcauucaaccaucccauacaaguugaucaacuaaauucuaguuacuucaaacuaucaauccccacaaauuucucauucggaguuacccaagaauauauucaaacaacaauccaaaaaguuacaguugacugcaaacaauacgucuguaauggauuccaaaaaugcgaacaacuuuuaagagaauauggacaauucuguucaaaaauaaaccaagcucuccauggugcuaaucuaagacaagaugacuccguccgaaauuuauucgccuccgugaaaagcucacaaaguuccccuaucauccccggcuucggaggagacuucaaccuuacucuccucgaaccaguaucaauauccacaggcagucguucugcaagaucagcaauagaagauuuacucuuugauaaaguuacuaucgcugacccaggauauaugcaagguuaugaugauuguaugcaacaaggcccagcaucggcccgagauuuaaucugugcacaguacgucgcagguuauaaagucuuaccuccacuaauggauguaaacauggaagcugcauacacaucauccuuauuagguaguaucgcaggaguaggauggacugcuggauuaucuuccuuugcagcaauuccauuugcacaaucuauauuuuaucgccuaaacgguguaggaauaacacaacaaguuuuaucugagaaccagaaauuaauugcgaacaaauucaaucaggcccuuggugcuaugcaaacuggguucaccacaacuaaugaggcuuuucauaaaguccaagaugcagucaauaauaacgcacaagcacuaucaaaauuagcaucagaauugucuaacacauucggcgccauuucagccucuauaggugacauaauccaacgucuugauguacuagaacaagaugcacaaauagacagguuaauaaauggcagauuaaccaccuuaaacgcuuuuguugcccaacaauuagucagaucagaaucagcagcucuaagcgcucaacuagcuaaagauaaggucaaugaauguguaaaagcccaaucaaaacgaucaggauucuguggccaaggaacucacauagucucuuucguaguaaaugcucccaauggcuuauacuuuaugcaugucggcuauuaccccucaaaucauauugaaguugucucagccuacggccuaugugacgcugcuaaccccaccaacuguauugcgccaguuaaugguuacuuuauaaaaacgaauaacacaagaauuguugacgaauggucauauaccggauccucuuucuacgcuccugagccaauaacaucgcugaacaccaaauacguagcaccccaaguaacauaucagaacauaagcacaaaucuaccacccccucuacuaggaaauuccacaggaauagauuuccaagaugaauuagaugaauuuuucaaaaauguaagcacuagcauccccaacuucggaucacuaacacaaauaaauaccacucuauuagacuugaccuaugaaauguuaucacuucaacaaguuguaaaagcacuaaaugaaucauauauagauuuaaaagaacuaggaaauuacacuuacuauaacaaauggccaugguauauaugguuaggauucauagcaggauuaguugcauuagcacuuugcguauucuuuaucuuauguugcacuggauguggcacaaacuguaugggaaaauuaaaguguaaucguuguugcgauagauacgaagaauacgaccuagaaccucacaaaguacacguccacuaa

SEQ ID NO: 1080 - RNA, 4062 nt, Artificial Sequence
  derived and/or modified CDS sequence (opt6) from MERS-CoV__AHI48605__S
augauucauucugucuuucuucuaauguuucuacuaaccccuacugaaucuuauguugauguagguccagauaguguuaaaucugcauguauugaaguagacauacaacaaacauucuuugacaaaacauggccaagaccuaucgauguaagcaaagcagacggcauuauauacccccaaggccguaccuauucaaacaucacuauuacuuaucagggauuauuuccuuaccaaggagaccauggagacauguacgucuacucagcuggacacgccacaggaacaaccccgcaaaaauuauuuguugcaaauuacucccaagauguaaaacaguuugcuaacgguuuuguaguaagaauuggugcagcagccaauucuacaggcacaguaaucaucucaccuuccacauccgcaacuauuagaaaaaucuacccagcuuucaugcuaggaucaagcguagguaacuucucagauggaaaaaugggccgauucuuuaaccacacacuuguucuacuaccagacggcugcggaacucugcuccgugccuucuauugcauucuggaaccacguaguggaaaccauugcccagccgggaacuccuauacaucuuuugcaacauaucauacaccggccacagauuguuccgacgguaauuacaaucgcaaugcgucucuuaauuccuuuaaggaauauuuuaaucuacguaacugcaccuucauguauacauacaauaucacugaagaugaaauuuuagaaugguucggaauaacucaaacagcucaaggaguacacuuauucucuucaagguacguagaucuauaugguggcaacauguuccaauuugcgacccuuccuguuuaugauaccauaaaguauuauucuauuauuccacacucaaucagaucaauacaaucagaucggaaggcuugggccgcauucuacguuuacaaauugcaacccuuaaccuucuuacuugauuucucaguagaugguuacauuaggagagcuaucgacugugguuuuaaugaucuaagccagcuacauugcucauacgaaucauuugauguagaaagcggcguauacucagucaguuccuuugaagcuaaaccuaguggcuccguuguugaacaagcugaaggaguggaaugugacuuuucaccucuccucucagguacaccaccacaaguauacaauuuuaaaagauugguauucacaaauugcaauuauaaucuuacaaaauuacuaucauuauuuucaguaaaugauuuuacaugcucacaaauaucuccugcugcuauagcaucaaauuguuauuccucauuaauucuagauuauuuuucauauccccuuaguaugaaaucagaccuuuccgucagcucugcaggaccaauaucacaauucaacuauaaacaauccuucucuaauccuaccugucuaauauuagcuacaguaccucauaaccuaacaacaauaacuaaaccguuaaaauauucauauauaaauaaauguucgcgccuccuaucagaugaucguaccgaagucccucaacuuguaaacgcaaaccaauauagcccaugcguaucuauaguacccucuacaguaugggaagauggugauuacuaccgaaaacaauuaucaccucuagagggagguggaugguuaguugccucaggaucaaccguagcaaugacugaacaauuacaaaugggcuucggaauaaccguccaauauggaaccgauacaaauucaguauguccuaaacuagaauuugcaaacgauacaaaaaucgcaucccaguuaggaaauugcgucgaguacuccuuauacggaguaagcggaagaggaguauuccaaaacuguacagcuguuggaguucgccaacaaagguuugucuacgaugccuaccaaaaucuuguuggauauuauucggaugacgguaauuauuauugucuaagagccugcguuaguguaccaguaagcgucaucuaugauaaagaaacuaaaacccaugcaacacuuuucggaucagucgccugcgaacauauauccuccacgaugucacaauacucacgcuccacucgaucuaugcuuaaacgcagagauucaaccuacgggccacuacaaacaccaguaggaugcguucuaggucucguuaacucaucccuauuuguggaagauugcaaauuaccacuagggcaaucacuuugcgcuuuaccagauacccccaguacacucacaccacgauccguacgaagugugccaggcgaaaugcgacucgccucaauagcguuuaaucacccgauacaaguagaucaacucaauucuucguauuucaaauuauccauaccaaccaacuucagcuuuggcguaacccaagaguacauccagacuacuauacaaaaagucacaguagacuguaaacaauacguaugcaacggauuucaaaaaugcgagcaauuauuacgcgaauacggccaauucugcuccaaaaucaaccaagcccuacauggugcaaauuuaagacaagacgacucagucagaaaucucuuugcaaguguuaaaaguagccagucauccccaauuauccccggauucggaggagacuucaaucuaacauuacucgaaccgguuucaauuaguacagguucucguagcgcuagaucagcaauugaagaucuauuauucgacaaaguuacuauagcugaucccggcuauaugcaaggauaugaugacugcaugcaacaaggaccugcuucagcacgcgacuuaauaugugcacaauacguagcaggauacaaaguauuaccuccuuugauggauguuaacauggaggcugcauauaccaguaguuuauuagguaguaucgcaggaguagguuggacagcuggauuaucaaguuucgcugcaauaccuuuugcacaaucuauauuuuaccgcuuaaauggaguuggcauuacucaacaaguucuuucggagaaucaaaaauuaauagccaauaaauuuaaccaagcacuuggagccaugcaaacaggauucacuacaaccaaugaagcauuccauaaaguacaagacgcuguaaacaauaaugcccaagcauuaucaaaacuugccuccgaacuuucuaacacauucggagccauaucagcauccauuggagacauuauccaaagauuagacgucuuagaacaagaugcacaaauugauagacuaauuaacggaagauuaaccacucuaaaugcauucguggcucaacaauuaguaagaucggaauccgccgcacucuccgcacaauuagcaaaagacaagguaaaugaaugugucaaagcccaauccaaacgaucaggauuuuguggccaaggcacccauaucguaaguuuuguuguaaaugcgccuaacggucuauacuuuaugcaugucgguuacuacccaucaaaccacauagaaguaguuucugcauacggucuaugugacgccgcuaauccaaccaacuguauagcacccguaaauggauacuuuauuaaaacaaauaauacccguauaguugacgaaugguccuauaccggauccucauuuuacgcucccgaaccaaucaccucucugaacacaaaauauguagccccucaagucacauaucaaaacauauccacuaacuuaccucccccucuucuagguaauucaacuggaauagauuuccaagacgaauuagacgaauuuuucaaaaauguuucaacauccauuccaaacuucggaucacuuacacaaauaaacaccacauuacuagacuuaacauacgaaauguuaagccuacaacaaguaguaaaagcauuaaaugaaucauauauugaccuaaaagaacuuggaaacuauacauauuacaauaaauggccuugguauauauggcucggauuuaucgcugggcuugucgcucuugccuuauguguauuuuucauacuuuguuguacugguugugggacaaacugcaugggcaaacuuaaauguaaucgauguugcgacagguacgaagaauaugaucuggaaccucacaaagugcacguacacuaa

SEQ ID NO: 1081 - RNA, 4062 nt, Artificial Sequence
  derived and/or modified CDS sequence (opt6) from MERS-CoV__AHY21469__S
augauacauucagucuuucuuuuaauguucuuauuaacucccacagaaucauacguagauguaggaccagacucuguaaaauccgcuuguauugaaguagauauucaacagacauucuucgauaaaacauggcccagaccaauagauguaucuaaagcagaugguauuauauauccucaaggucgcacauacucuaauauuaccauaacauaucaaggguuauucccuuaucaaggcgaucauggggauauguacguauauagcgcaggacacgcaacuguaacaacaccucagaaacuuuuuguagcuaacuauucucaagacguaaaacaauuugcuaacgguuuuguaguccgcaucggagcugcagcgaacucaacagguaccguaauaauaucaccaagcacauccgcaaccauucgcaaaaucuacccugcuuucauguuaggcucaucaguagguaauuuuuccgacgguaaaaugggaagauucuuuaaucauacauuaguucuacuucccgacgguugcgguacacuauuacgcgcuuucuacugcauccuugaaccacgaucagguaauuauugcccugcugguaacuccuauacaucuuuugcaacuuaccacacccccgcaacugacugcucagauggaaacuauaauagaaaugcuucgcucaacagcuucaaggaauauuucaaucugagaaauuguacuuucauguacacauauaacauaacagaggaugaaauacuagagugguucggaauuacacagaccgcucaaggagugcauuuauucagcucaagauaugucgauuuauacggcggaaauauguuucaauucgccaccuuaccuguuuaugacacgauaaaauacuauucaauaaucccucauaguauacuauccauacaaucugaccgaaaagcaugggcugcauuuuacguauauaaauuacaaccucuaacauuucuauuagauuucucuguugacggcuauauacgccgugcaaucgauugcggauuuaaugaccucucacaacuccacuguuccuaugaaaguuuugauguggaaucugguguauauucaguuucgaguuuugaagcgaagcccuccggcuccguugucgaacaggcugaagguguugaaugugauuuuucuccucuucucucagguacaccuccgcaaguguacaauuucaaaagauuaguauucaccaauugcaauuacaacuuaacuaaauuacuuuccuuauuuucuguaaaugauuucacauguucacaaauaagcccugcugccauagcaucaaacuguuacucaucauuaauacucgauuacuuuucuuaucccuuaaguaugaaaucagauuuauccgucucuuccgcaggcccaauaucccaauucaauuauaaacaaucauuuucaaacccaacaugucuuauucucgcgacagucccgcauaauuuaacaacuauaacuaaaccacuaaaguauaguuauaucaacaaauguucacgauuauuaucagacgauagaacagaaguaccacaauuaguaaacgcuaaucaauacucacccuguguaucuaucguaccuucaacuguuugggaagacggagacuauuaccgaaaacaacucucaccgcucgaagguggggguuggcuaguagcaucaggcuccacaguagcaaugacagaacaguuacaaaugggcuucggaauaacaguucaauaugguacagacacuaacagcgugugcccaaaauuagaauuugcaaacgauacgaaaaucgcaucucaauuaggcaauuguguagaauacucacuauaugguguaaguggaagaggaguauuccagaacuguacagcaguaggaguaaggcaacaacgauucguauaugaugcauaucaaaacuuaguagguuauuacuccgaugauggaaauuacuauugucuaagagcaugcgucuccguuccuguguccgucauuuaugauaaagaaacaaaaacccacgcaacauuguuugguuccguugcuugcgaacauauaucuucuacuaugucccaauauucaagauccaccagaucuauguuaaaacgaagagacucaaccuauggucccuuacaaaccccuguaggauguguucucggauuaguuaacucuucccuauuuguugaagacugcaagcuaccucugggacaaucucucugugcuuuaccugauacacccuccacauuaacaccuagauccguaagaucaguaccaggagaaaugcgauuagcaucaauugcauuuaaccacccaauccaaguagaucaacuuaauuccucuuauuucaaauuaagcauacccacaaacuucucuuucgggguaacucaagaauacauacaaacgacaauacaaaaaguuaccguugacuguaaacaauauguguguaacggauuucaaaaaugugaacaacuauuaagagaauacggucaauucuguucaaaaauaaaucaagcucuacacggagcgaauuuacgccaagacgacuccguccguaaucuauuugcaucagucaaaaguucacaaucaucuccaaucauaccaggauucggcggugauuuuaaccuuacauuacuagaaccaguaagcacuucuaccggauccagaucagcucgcucagcuauugaagaucuucuauucgacaaaguuaccaucgccgauccuggauauaugcaaggauacgacgacuguaugcaacaagguccagcaagcgcccgagacuuaauaugugcucaauauguugccggcuacaagguccuaccgccuuuaauggacgucaacauggaagcugcauauacaucuucucuccuaggcaguauagccggagucggauggaccgcuggucuaucuucauucgcagcuauccccuucgcacaaucuauauucuaccgauuaaaugguguuggcauaacacaacaagucuuaagcgaaaaucagaaacuaauugcaaauaaauucaaucaagcucuaggcgcuaugcaaacaggauuuacuacuacuaacgaggccuuucaaaagguacaagacgcuguaaauaacaacgcacaagcacuuuccaaacuagccucagaacuaucaaauacauuuggagcaauaucagcuucgaucggagacaucauccaacgucuugauguacucgaacaggaugcccaaauagauaggcuaauaaaugggcgacuaacgacacuaaacgcguucguggcgcaacaacugguaagaucagaaucugcugcccuauccgcccaacucgcaaaagauaaagugaaugaguguguuaaagcacaaucaaagagaucugguuucuguggccaaggaacccauauuguaucauucguuguaaaugcaccaaacggucucuauuuuaugcauguaggcuauuacccauccaaucacaucgaaguggugucagcuuauggacuaugcgauucggcaaacccaacaaauuguauagcaccuguaaauggauauuuuauaaaaacaaacaauacuagaauaguugacgaauggaguuauaccggcuccaguuuuuacgcaccagaacccauaacaagucuaaacacaaaauacguagcuccacaaguuacauaucaaaacauuucaacaaaucuacccccaccguuacucgggaauagcacuggaauagacuuucaagacgaauuggaugaauuuuucaaaaauguaucaacuuccauaccaaauuuuggaucuuuaacacaaauaaacacaacauuauuagaucuaacauaugaaaugcuuucauuacaacaagucgugaaagcacuuaacgaaaguuauaucgacuuaaaagaacuuggcaacuauacauauuauaacaaauggccuugguacauauggcuuggcuucauagcuggauuaguagcccuagcauuaugcguuuucuuuauucuaugcugcacuggaugcgguacgaauuguaugggaaaacuuaaauguaacagaugcugcgaccguuaugaagaauacgaucuagaaccucauaagguacacgugcauuaa

SEQ ID NO: 1082 - RNA, 4062 nt, Artificial Sequence
  derived and/or modified CDS sequence (opt6) from MERS-CoV__AHZ64057__S
augauacauuccgucuuccuauuaauguuccucuuaaccccuacagaaagcuacguggauguuggcccugauaguguuaaaucagccuguauagaaguugauauccaacaaacuuucuuugacaaaaccuggccccgcccaauagauguaucaaaagcagauggaauuauauacccacaagguagaacauacucaaacaucaccauaaccuaucagggacuuuuuccauaccaaggcgaucacggagauauguaugucuacucagcuggacaugccaccggcaccacaccacaaaaacuguuuguagcaaauuauucacaagauguaaaacaauuugcaaaugguuuuguagucagaauaggcgcagcagccaauaguaccggcaccguaaucauuucaccuucaacaucggcaacaauaagaaagauauacccugcuuucaugcugggcagcucugucgguaauuuuucagaugguaaaaugggccguuucuucaaccauacauugguacuacuucccgaugggugcgguacacuccuacgcgcuuuuuacuguauacuagaaccaagaucugguaaccauugucccgccgguaauucauacacaucauucgcuacguaucauacaccagcaacagacuguucagauggcaacuauaauagaaaugcaucccuuaacucauucaaagaauacuuuaaccuaagaaauuguaccuuuauguauacauacaauauaacugaagaugaaauauuagaaugguuugguauuacccaaacugcacaagguguucaucuauuuucaucaagauacguagaucucuacggugguaauauguuccaauucgcaacauuaccuguuuacgauacaauaaaauauuauaguauaauaccucauucaaucagaucaauccaaucugacagaaaagcaugggcugccuuuuauguauacaaacuacaaccacucaccuuuuuacuagauuucucaguagauggcuauauaagacgagcaauagauugcggauucaaugacuuaagccaacuacauuguucuuacgaaaguuucgauguagaaaguggaguguacucagucuccaguuuugaggcaaaaccauccggauccgucguagaacaggcugaagggguagaaugugacuucucgccauugcucucaggcacaccuccacaagucuacaacuuuaaaagacuugucuuuaccaauugcaauuacaaccuaacaaaacuucucagucucuuuucgguaaaugacuuuacuugcucucaaauuucuccagccgcgauagcaucaaacuguuauaguucacucauccuagauuauuucucauacccauugucaaugaaaucagaccuaagcgucagcuccgccggcccaauaagucaauucaacuacaaacaaucuuucucuaauccgacuugccuaauccuagcaacagucccccacaaucuaacaacgauaacuaaacccuuaaaauauucauauaucaauaaauguagucgcuugcucucagacgaccgaacugaggucccucagcuaguuaaugcaaaucaauauucaccuuguguuucaauuguaccuuccacuguaugggaagacggugauuacuauagaaagcaauuaucaccucuugaagggggaggcugguugguugcuucaggcagcacaguagcgaugacugagcaauuacaaaugggauucggaauaacaguacaauaugggacagacacgaacucuguaugucccaaacucgaauuugcaaacgauacgaaaauagcaucucaacugggaaauuguguugaauauagcuuauacggcguaucaggucgcggaguuuuucagaauuguacagcagucggcguacgacaacaaagauuuguuuaugaugcauaccaaaaccuaguaggauauuauucugaugacggcaacuauuacugcuuacgggccugugucucaguccccguaucaguuauuuacgauaaagaaacaaaaacacacgcaaccuuauuuggaucaguugcuugcgaacauauauuuagcacaaugucccaauauucacgcaguacuagaucaaugcuuaaaagaagagauucuaccuacggaccacuacaaacaccaguuggaugcguuuuaggacuuguuaauuccagcuuauuuguugaagacugcaaacuaccacucggacaaucacuaugcgccuuaccugacacaccaaguacccuuaccccaagaucaguacgguccguaccuggagaaaugcgucuagcaucaauagcauuuaaccauccgauucaaguagaucaauuaaacucuuccuauuuuaaacuaagcauaccuacaaauuucucauucggaguuacucaagaauauauacaaacaacaauacaaaaagugacuguagacuguaaacaauacguauguaacggcuuccagaagugugaacaacuucuucgagaauauggucaauucuguucgaaaauuaacagagcauuacacggugcaaauuuacgacaagacgacuccguacgcaaucuuuuugcuucagucaaaaguucacaauccucuccuaucauaccgggauucggcggagauuuuaaccuuacauuauuagaacccguaucaauuaguacaggaagccgaucagcaagaucugccaucgaggaccuacuauucgacaagguuacaauagccgacccuggcuauaugcaaggcuaugaugacugcaugcaacaagguccugcuuccgcaagagaucuuauuugcgcacaauauguugcugguuacaaaguauuaccuccguuaauggauguuaauauggaagcugcuuauacaucaucacuccuugggucaauagcuggugucgguuggaccgcaggauuaucaucuuucgccgcaauaccauucgcucaaaguauauuuuaucgucuaaacggugucggaauaacucaacaaguacuaagcgaaaaccagaaacuuauagcuaauaaauucaaccaagccuuaggagcaaugcaaacaggauuuacuacaacaaacgaagcauuccgaaagguacaagaugcuguaaauaacaacgcacaagcauuguccaaacuagcaucagaacuauccaauacauuuggagcuaucucagcuuccauaggagacauaauccaaaggcuugacguacucgagcaagaugcucaaauagacaggcucauuaacggacgacuuacuacacuaaacgcguucguagcccaacaacuugugagaucagaaucagcagcauuaagugcacaauuagcaaaagacaaaguaaacgaaugcgugaaagcucaaucuaaacguucgggauuuuguggucagggaacccacaucguaucuuucguaguaaacgcaccaaauggauuauacuuuaugcaugucggauauuaccccucgaaucacauugaaguuguuucagcauauggauuaugcgacgcugccaaccccacaaauugcauugcgcccgugaauggcuacuuuauaaaaacuaauaacacaagaauaguagaugaauggucauacaccgguaguucauuuuacgccccagaaccuauuacuucccuuaacacgaaauacguagcaccacaaguaacuuaucaaaauauuucaacaaaccuucccccuccauuacuaggcaacucgacuggcaucgauuuucaggacgaacucgaugaauuuuucaaaaacguaucuacaaguauaccuaacuucggaucacuuacucaaaucaauaccaccuuacuugacuuaacauaugaaaugcuuagucuacaacaaguaguaaaggcauuaaaugaaagcuauauagauuuaaaagaacuaggcaauuauaccuacuauaauaaguggccaugguacauuuggcuaggcuuuauugcuggacuuguagcauuagcauuauguguuuucuuuaucuuauguuguacaggcuguggaacaaauuguaugggaaaauuaaaauguaauagauguugugaccguuaugaagaauacgauuuagaaccacauaaaguacacguccauuaa

SEQ ID NO: 1083 - RNA, 4062 nt, Artificial Sequence
  derived and/or modified CDS sequence (opt6) from MERS-CoV__AID50418__S
augauucauagcguuuuucuucuaauguuccuacuuacaccaacagaaagcuacguagauguuggucccgacaguguaaaaucugcuuguauagaaguugacauacaacaaacauuuuucgauaaaacuuggccccgaccuauagauguuucaaaagcagacggaaucauauacccacaaggaagaaccuauucaaacaucacaauaacuuaccaaggccuuuucccuuaccaaggugaucauggcgacauguauguauauucugcgggucacgccacaggcacuacaccccaaaaacuauucgucgcaaauuauucacaagaugucaaacaauuugcuaauggauucguugugcgaauaggagcugcagcaaacucuacaggaaccguaauuauuucaccuucaacaagugccacuauaaggaagaucuacccagcuuuuaugcuuggcucaucaguugguaacuucucagaugguaaaaugggcagauucuuuaaccacacacuuguacuuuuacccgauggcuguggaacauuacuacgugcuuuuuacuguauuuuagaacccagaucugguaaucauuguccagcagguaacuccuacacuuccuuugcaacauaucauacccccgcaaccgacugcagcgacgggaauuauaauagaaaugcuucccuaaacuccuuuaaagaauacuucaaucuccgaaauugcacauuuauguauaccuacaacaucacagaagaugaaauucuagaaugguucggaauaacccaaacagcucaggguguacacuuauuuucaucacgauauguagauuuauacggcggaaacauguuucaguucgccacucugccugucuaugauaccauuaaauauuauucuauaauaccccacucaauaagaucaauccaaagugaucgaaaagccugggcagcauuuuaugucuacaaacugcaaccacuaacuuuucuacuugauuuuuccguugacgguuacauccguagagcuauugauuguggauucaaugauuuaucacaauuacauuguuccuaugaaucuuuugacguagaaucaggaguauacucuguaucuucauuugaagcaaaaccgucagguuccguagucgaacaagcggaaggcguagaaugugauuuuaguccccuuuuaagugguaccccuccccaaguauauaauuucaaaagauugguauuuacuaauuguaacuacaauuuaacaaaauuauuaucguuauucucaguuaacgacuucacaugcucacaaaucuccccugcugcuauagcaaguaauugcuauagcucacuuauacuugauuacuuuuccuacccgcucaguaugaaaucagaucuauccguuucuucagccggccccauaagucaauucaauuauaaacaaucauucagcaacccaacaugucuaauccuagcuacaguaccucauaaucuaacaacaaucacaaaaccccuaaaauauucuuauauaaauaaauguagccgauuacuaagcgaugacagaacagaaguaccucaauuaguuaaugccaaccaauacaguccauguguauccauaguuccaaguaccguaugggaagacggagauuacuaccgaaaacaacuaucuccccuugaaggcggaggcuggcuaguagcuaguggcucaaccguagccaugacagagcaacuccaaaugggcuuugguaucacgguacaauacgguaccgacacaaacagcguauguccaaaauuagaguucgccaaugauaccaaaauagcaucacaauuaggcaauugcguugaauauagcuuauaugguguaucuggaaggggaguauuccagaauugcacagcugucggcguuagacaacagcguuuugucuacgacgcauaccaaaauuuagucgguuacuacagugaugauggcaacuacuacugccuaagagccugugucucaguaccaguuucaguuauauaugauaaagaaacaaaaacccacgcaacacuauucggauccguagcaugcgaacauauuaguucgacgaugucacaauauucgagaucaaccagaucuaugcuuaaacgacgagacucaacuuacggaccacuacagacaccuguuggcugcgucuuaggccucguaaauaguucuuuauuuguagaagauuguaaacuuccacuugggcaaucucuuugcgcacuccccgauaccccuucaacccucaccccacgcagcguuagaucuguuccuggugaaaugagauuagcgucaaucgcauuuaaccauccuauacaaguggaucagcuuaauucaucuuacuuuaaacucucaauucccacaaacuuuucauucggaguuacacaagaauacauucaaacuacuauacaaaaaguuacagucgauuguaaacaauacguauguaauggcuuccaaaaaugugaacaauuauuacgugaguauggacaauucuguucuaagauuaaucaagcacugcacggugccaacuuacgccaagacgacucaguaaggaauuuauuugccuccgugaaaucaucucaauccucaccgauuauaccuggcuuuggaggggauuuuaaucuaacccuguuagaaccuguaucaauuucuacaggcucgagaucagccagaagugcaauagaagaucuacuauucgauaagguuacuauugcagacccuggcuauaugcaaggcuacgacgauugcaugcaacaaggcccagcuagcgcuagagauuuaauuugugcacaauauguugcaggcuacaaaguccuaccuccccuuauggaugucaacauggaagccgccuauacuucaucucuccuagguucaauagcuggcguaggcuggacagcugguuuaucaucuuucgcugcaauuccauuugcccaauccauauuuuauagacuaaacggaguaggcauuacucagcaaguauuaucagaaaaccaaaaacuaauagcaaauaaauucaaucaagcacucggcgcuaugcaaacagguuuuacuacaacuaacgaagcauucaggaaaguccaagacgccguaaauaauaacgcucaagcucuaucaaaauuagcauccgaacuuucaaacacauuuggugcuauuuccgcaaguauaggagacauaauacaacguuuggacguucuagaacaagacgcacaaauagaucgauuaaucaauggcagacucacgacacuaaaugcauuugucgcacaacaguuaguccgaucggaaagcgcugcccuuucagcacaacuagcaaaagacaaagucaaugaaugcguaaaggcucagucuaaacgaucuggauuuuguggucaagggacacauauagugaguuuuguuguaaacgccccaaauggucuuuacuuuaugcauguuggcuauuacccaucaaaucauaucgaaguagucucugcuuauggccuaugugacgccgccaauccaacaaauuguaucgcaccuguaaauggauacuucaucaagacuaauaauacacgaauaguagaugaauggucauauacagguaguucauuuuacgcaccugaaccuauaaccucccuaaauacuaaauacguugcuccacaaguaacauaucagaacauaucaacaaaucuacccccaccauuacuuggaaacucaacaggaauagauuuucaagaugaacuggacgaguucuuuaaaaauguuucuacaaguauucccaauuuugguucuuuaacucaaaucaacacaacccuucuagaccucaccuaugaaauguuaucauuacaacaagucguuaaagcauuaaaugaaucauacauagaucucaaagaacuaggcaacuauaccuauuacaacaaguggccaugguacaucugguuaggauuuauugcuggauuaguugcacucgcuuuauguguauucuucauacuuugcugcaccggauguggaacuaauugcaugggcaaacuaaaauguaaucgcuguugugauagauaugaagaauacgaucuagaaccgcauaaaguccauguacacuaa

SEQ ID NO: 1084 - RNA, 4062 nt, Artificial Sequence
  derived and/or modified CDS sequence (opt6) from MERS-CoV__AID55068__S
augauacacaguguauuccucuuaauguuucucuuaacaccuaccgaaucauacguagacguaggcccugauucgguaaaaucugccuguauugaaguugauauacaacaaacuuucuuugacaaaaccuggccucggccaauugauguaucuaaagcagaugggauuauauauccgcaaggucguacuuauucaaauauaacaauuacuuaucaaggccuuuuuccauaccaaggagaucacggcgacauguaugucuauucagcaggucaugccacuggaacaacaccccaaaaacuuuucguugcgaacuacucucaagauguaaaacaauucgcaaacgguuuuguaguucgaauaggugcagcagccaauucuacagguacaguaaucaucucuccaucaaccucugcaaccauccguaaaauauauccugcauucauguuaggaucuucaguugguaacuucagugauggcaagauggggcgcuucuucaaucauacucucguauuauuaccugacggcugcggcacacuauuaagagcauucuauuguauucuugaaccacgaucggguaaccacugucccgcuggaaacucuuauacgucauuugcaacuuaccacacacccgcgacagauugcuccgauggaaacuauaaucgcaaugcaucucuaaauuccuuuaaagaauauuucaauuuaagaaacugcacuuuuauguacacauauaauauuacagaagaugaaauucuugaaugguucggaauaacccaaacagcucaaggaguacaucuauuuucgucaagauacgucgacuuauacggcggaaacauguuccaauuugccacccuucccguauaugacaccauuaaauauuauuccaucauaccacauucuauaagaucaauacaaagcgaccgaaaagccugggcugcguuuuacguauauaaacuacaaccucucaccuuucuacuugauuuuucuguugauggauauauucggagagcaauagauugcgguuuuaacgaucuaagucaacuccauugcucuuaugaauccuuugacguagaaagcggaguuuauucaguaaguucauuugaagcaaagccuagugguuccguuguugaacaggcugaaggaguagagugcgauuucucacccuuauuaucaggaacaccaccacaagucuacaauuuuaaacgauuaguauucaccaacugcaauuauaaucuaacaaaauuauuaucacuauuuaguguaaacgauuuuacauguucacaaauaaguccugcagccauugcuuccaauuguuauaguucuuuaaucuuagauuauuuuuccuauccuuugagcaugaaaucugauuuaaguguuaguagugcaggucccaucucgcaauucaauuauaaacaaucauuuuccaauccaacaugucuuauacucgcuaccguuccucauaaccucacuacaauaacuaaaccuuuaaaauacucauacauaaauaagugcucaagacuucuaucagacgacagaacagaaguaccccaauuagucaaugcaaaccaauauucgccguguguauccauugucccaucaacuguaugggaagauggagauuauuaccgaaaacaauuaucuccccucgaaggaggaggcuggcuaguagcguccgguagcacaguagcaaugaccgaacaacuccaaauggguuucgguauaacuguacaguauggcacugauacaaacucaguaugucccaaacucgaauuugccaaugacacaaaaauugcaucacaacuuggcaacugcguugaauacucacuauauggagucucagggcgaggaguuuuccaaaacugcacugccguaggaguacgacaacaacgauuuguauaugaugcauaccagaaucuaguuggcuacuauucagacgauggcaacuauuacugccuacgagcuuguguuucagucccugucucaguaauauacgacaaagaaacuaaaacucaugcaacacuauucggcaguguggcuugugaacacauaagcaguaccaugucccaguauucuaggaguacacguuccaugcuuaaacgacgugacaguacauauggaccauuacaaacaccaguuggauguguauuaggucuaguuaauucaucacuuuucgucgaagauuguaaacuuccauuaggccaaucuuugugugcacuacccgauacaccaucaacacucacuccacgaagcguuagaucugucccgggagaaaugcgauuagcuuccaucgccuuuaaucacccaauacaagucgaccaacucaauuccucuuauuucaagcuaucaauuccaacaaauuuuagcuuuggaguaacccaagaauauauacaaacuacaauacaaaaagucacaguugacuguaaacaauaugucuguaauggcuuucagaagugcgagcaauuauuaagagaauacggacaauuuugcucaaaaauaaauagagcuuuacauggcgcuaaucuaagacaagaugacucaguucgaaaccucuuugcuaguguuaaaagcucacaaucuucgccaauaauaccuggauuuggaggagacuucaaucuaacacuacuugaaccuguaucaauuucaacgggaucacgcucagcacgaagugcuauagaagaccuguuauucgacaaaguuacuauugcagacccaggauacaugcaaggauaugaugacuguaugcaacaaggcccagcuucagccagagaucuuauuugcgcccaauauguagcaggauacaaaguccucccaccccuuauggauguuaauauggaggcagcuuauaccuccucacuacuagguucaauagcuggaguuggcuggaccgcaggucuaucuuccuucgcagcuauacccuucgcacaaucaauauucuauagacuaaaugggguuggaauaacacaacaaguacucucugaaaaccaaaaacugaucgccaacaaauuuaaccaagcacuaggagcuaugcaaacaggauuuaccacgacuaacgaagccuuccgaaaaguucaagacgcaguuaacaauaaugcccaagcccuuuccaaacuagcuucugaacuguccaauacauucggcgcaaucucagcuuccauaggagauauaauacaaagacuugacguacucgaacaagaugcacaaauugaucgucucauuaacggacgucuaacaacacuuaacgcuuuugucgcccaacagcuaguuagaucagaaucugccgcacuuuccgcgcaacuagccaaagacaaagugaacgaaugugugaaagcacaaucaaaacgaucaggauuuugcggucaaggcacacauauagucagcuuuguaguaaaugcuccuaauggcuuauauuuuaugcauguaggauacuacccaucuaaucauauagaaguaguuucagcuuauggcuuaugugacgcagcaaacccaaccaacuguauagcccccguaaacggauauuuuaucaaaacaaauaacacuagaaucguagacgaaugguccuauacaggauccagcuuuuaugcuccagaaccaauuacuucucuuaacacaaaauaugucgcuccucaaguuacuuaccaaaauaucucaacaaaccuaccaccaccauuacuaggaaauucgaccggaauugacuuucaggacgaauuagaugaguucuucaaaaauguguccacuuccauaccaaauuucggauccuuaacacaaaucaauaccacucuacucgacuuaacauacgaaauguuauccuuacagcaaguaguaaaagcauuaaaugaaaguuauauagaucuaaaagaauuaggaaacuauacauacuauaacaaauggccaugguacauuuggcuugguuucauagcaggucuuguagcacuggcacuauguguauucuucauucuuugcuguacagguuguggaacaaacuguauggguaaacuuaaauguaaucgauguugcgaccgauaugaggaguacgauuuagaaccacauaagguucauguacauuaa

SEQ ID NO: 1085 - RNA, 4062 nt, Artificial Sequence
  derived and/or modified CDS sequence (opt6) from MERS-CoV__AID55073__S
augauucauucaguauuucugcuaauguuucuucuaacaccaacugaaucuuacguagacguaggaccugauuccguaaagucagccuguauugaaguagacauucaacaaacuuucuuugacaaaaccuggccaagaccaauugacgucucaaaagcugacggaauaauauauccccaagguagaaccuauaguaauauaacuauaacuuaccaaggauuauuuccuuaccaaggcgaucacggagacauguauguauacucugccgggcacgcaaccgggaccacaccucaaaaguuauuuguggcaaacuauucucaagauguuaaacaguuugccaauggauuugucguuagaauaggugcagcugcaaauucaacagguaccgucauaauuucuccauccacuucugcuacuauacgaaaaaucuacccugcauucaugcuaggaucaucuguuggcaacuucuccgacgguaaaaugggacguuucuuuaaucacacauuaguucuacuacccgacgguugcggaacucuacuuagagcauuuuauuguauacuugaacccagauccggaaaucauugcccagccggcaacaguuacacaucauuugccacauaccauacuccagcaaccgacugcagugauggcaauuacaauagaaacgcaucucuuaacucauuuaaagaauacuuuaauuuacguaacuguacuuucauguacacuuauaacauuacagaagaugaaauuuuagaaugguuuggaauaacacaaacugcucaaggugugcaucuauucuccucccgauacguagaucuauacggaggaaacauguuccaauucgcaacacuaccaguauaugacaccaucaaauauuacucuaucauaccccauagcauucguucuauucagucagaucgcaaggccugggcagcauucuacguauauaaacugcaaccuuuaacauuccuacuugacuuuucaguagacggauacauucguagagcaauagauugugguuuuaacgauuuaucucaacuucauuguucguacgaauccuucgauguagaaucuggaguuuauucaguaagcucauuugaagcaaaacccucgggaaguguugucgaacaagccgaagguguugagugcgauuuuucaccauuguuaucuggaaccccuccgcaaguauauaauuuuaaacguuuagucuuuacaaacuguaauuauaacuucacaaaacuacuaucacuuuucucuguaaacgacuucacuuguucccagauaucuccagccgcaauagcaucgaacuguuacucaucuuuaauacucgauuauuuuucauauccacucagcaugaaaucagauuuaucuguuaguuccgccgguccaauaucacaauuuaauuacaaacaaucauuuuccaacccuacuugucugauucuugccacaguaccgcauaaucuaaccacuauaacaaaaccacuaaaauacuccuacaucaauaaaugcucccgcuuacuuagugacgaccgaacagaaguaccacaacucgucaacgcaaaucaauacucgcccuguguaucaaucguuccuucuacaguaugggaagacggugauuauuaucgaaaacagcuaucuccccuagaaggaggggguuggcuuguagcaagcggaagcacaguugcaaugaccgaacaacuucaaaugggauuuggaauuacaguacaauacggaacugauacuaacagcguaugcccuaaacuagaguucgccaacgacacaaaaauagcaucacaacucggaaacuguguagaauacucccuuuacgguguguccggaagaggagucuuucaaaacuguacugccguaggcgucagacaacaacgcuuuguuuacgaugcguaccaaaacuuaguagguuacuacucugaugacggaaauuauuauugccuuagagcuuguguaucuguacccguuagugucauuuacgauaaagaaacgaagacccacgcuacauuguucggcagugucgcaugugaacauauuuccucuacgaugucacaauacucuagaucaacccgaaguauguuaaaaagaagagauuccaccuauggaccccuacaaacuccagucgguuguguuuuaggccuaguaaacucaagccuauucgucgaagauuguaaauuaccuuuaggacaaagccuaugcgcauuaccagauaccccuagcacgcuaacuccacguucaguucgauccgucccuggagaaaugcgccuagccucuaucgcauuuaaccauccaauucaaguugaccaauuaaauucaucuuauuucaaauuaucuauuccaaccaauuuuucuuucggagucacacaagaauacauccaaacaacgauucaaaaaguaaccguagauugcaaacaguauguaugcaauggcuuucaaaaaugcgaacaacuucuaagagaauaugggcaauuuuguagcaagauuaaucaagcucuacacggagcaaaccuccgacaagaugacucuguaagaaaccuauucgcaucaguuaaaucuagucaaucaucacccauuauaccaggauucggaggugacuucaaucuaacucuauuagaacccgucuccauaucgacaggaagucgauccgcaagaucugcuaucgaagaucuauuauucgauaaagucacaaucgcagauccuggguacaugcaaggauaugacgauuguaugcaacaggggcccgcuagugcacgagaucucauaugcgcucaauacgucgcaggauauaaaguucuaccgccucugauggaugucaauauggaagcugcguacacaucgucacuacuaggcuccauagcuggaguuggcuggacugcaggacuauccucuuuugcugcuauacccuuugcacaaucaauauuuuauagacugaacggugucgguauuacucaacaaguauuaucugaaaaccaaaaacuaauagccaacaaauucaaccaagcacuaggagcaaugcaaacaggauuuaccacgaccaaugaagcauucagaaagguacaagaugcgguuaauaacaaugcacaagcucuauccaaauuagccucggaauuaaguaacacuuuuggcgcuauaucugcuaguaucggagauauuauacaacgauuagacgucuuggaacaagacgcacaaaucgauagacuaauuaacggaagacuaacaacacuaaacgcauucguugcacaacaauuaguccgaucggaaucugcagccuuaagugcccaacuagcaaaagauaagguaaacgaaugcguuaaagcacaguccaagcgaucugguuuuuguggucaaggaacgcauauaguuucauucguaguaaacgcaccuaauggucuauauuuuaugcauguaggauauuauccaucgaaccacaucgaaguaguuucagcuuauggacuuugcgacgcagcaaauccaaccaacuguaucgcaccaguaaacgguuacuuuauaaaaacaaauaacacccgaauugucgacgaauggaguuauacaggaucgucuuucuaugcaccugaacccauuaccucuuugaauacuaaauacguugcaccgcaagucacauaucaaaauauaaguacaaauuugccaccuccucucuuagguaauucaacaggaaucgauuuucaagacgaacucgaugaauuuuucaaaaacguuaguaccaguauacccaacuuuggcucacucacucagauaaauacuacuuuauuagacuugacauacgaaaugcuuucucuacagcaaguaguuaaggcacuaaaugaaaguuauauugauuuaaaggaacucggaaauuauacauacuauaacaaguggccaugguauaucuggcucggguuuauagcaggacucguagcacuugcacucuguguuuucuuuauucuaugcuguacaggcugugguacaaacuguaugggcaaauuaaaauguaaccgaugcugcgaucgcuaugaggaauacgaccuagaaccacacaaaguacauguacauuag

SEQ ID NO: 1086 - RNA, 4062 nt, Artificial Sequence
  derived and/or modified CDS sequence (opt6) from MERS-CoV__AIY60528__S
augauacacucgguauucuuauuaauguuccuucuaacuccaaccgaaagcuauguugacguuggaccagauucuuuuaagucagccugcauugaaguugauauucagcaaacauucuuugauaaaaccuggccucgaccaauagacgucaguaaagcagauggcauuauuuacccccaagguagaacuuauucuaauauaacaaucaccuaucaaggacuauucccuuaccaaggcgaccacggggacauguauguauacucagcaggucacgcuaccggaacuacaccacaaaaauuauucguagccaacuauagccaaaauguaaaacaauuugcaaacggauuuguagucagaauaggugccgcggccaauuccacagguacagugauaauaagcccauccacuucagcuaccauucguaaaauuuauccagcauucaugcuaggcucuagugugggcaauuuuagugauggaaaaaugggcagguucuuuaaccacacgcuuguccuccuaccugaugguugcggcacacuacuucgugcguuuuacugcauauuagaaccaagauccggaaaccacuguccagcagguaauucauauacaucuuuugcuacauaccauaccccugcgacagauuguuccgacggaaauuauaauagaaacgcaucucuuaauuccuuuaaagaauacuucaaccuacguaauuguacauucauguacacauacaacauuacagaggaugaaauucuagagugguuugguauuacacaaacugcccaagggguacaccucuuuuccuccagauauguagaucuuuauggaggaaacauguuucaauuugcuacccuaccagucuaugauaccauaaaauauuacuccauaauaccucauagcauccgcucuauacaauccgaucgaaaagcaugggcagcauuuuacguuuacaaacuccaacccuuaacauuuuuacucgacuuuucuguagauggcuacauccgccgggcuauagacugcggauuuaaugaucucagucaacuacauugcucuuacgagucauucgacguugaaucuggaguauauucagucagcuccuuugaagcaaaaccuucaggaucaguagucgaacaagcugaaggcguagagugcgauuuuucuccccuacuuuccgggacaccaccucaaguauauaacuucaaacgauuaguuuuuaccaauuguaauuauaaccuaaccaaauuacucucuuuauucuccguaaaugacuuuacaugcucacagauauccccagcagcuauugcuaguaacugcuacucuucacuuauacuggauuacuuuagcuaucccuuaucaaugaaaagcgauuuaucuguauccucagcuggaccuauaucucaauuuaacuacaaacaauccuuuaguaauccaacgugucuuauucucgcgacagugccucauaaucuaacaacgauaacaaaaccacuuaaguacucauauauuaauaaaugcucaagguuacuaucugaugaucgaacugaaguaccucaacucguaaaugccaaucaauacagcccaugcgucaguauuguaccaucuacuguaugggaagauggugacuauuacagaaaacaacuuucaccauuagaaggaggcggauggcugguugcuaguggaucaacugucgcaaugacugaacaacuacaaauggguuucgguauaacaguccaauauggaaccgacacuaacucaguuugcccaaaacuagaauuugcaaaugauacuaaaauugcaucacaauuggguaacuguguugaauauucacuuuacggcguuucaggacggggcguguuucaaaauugcacugcaguugguguaagacaacaacguuucguauaugacgcauaucaaaaucuuguaggguacuauucagaugacgguaacuacuacugucuucgagcuugcguaucaguacccguuucagucauauaugauaaggaaacuaaaacacacgcaacucuauucggcucaguugccugcgaacauauaaguucaacuaugucacaauacucacgcucaacaagauccaugcucaaaagaagagauuccacauauggcccacuccaaacaccaguuggaugcgucuuaggucuaguaaauuccucacuauuuguagaggauugcaaauuaccacuaggacaaucucucugcgcauuaccagauacacccucuacauuaacgccaaggucaguuaggaguguuccaggcgaaaugagacucgcauccauagcuuuuaaccauccaauccaaguagaucaacucaauuccucauacuucaaauuaaguauaccuacaaauuuuucauuuggcgucacacaggaauauauacaaacaacuauacaaaaaguaacagucgauugcaaacaauauguuugcaauggauuccaaaaaugugaacaacucuuacgagaauacggacaauuuuguucaaaaauaaaccaagccuuacauggagccaaucuacgacaagacgacucaguuagaaaccuauuugccucaguaaaaagcucccaaucauccccuauaauaccaggauuuggcggagauuuuaaucuaacccuacuagaaccagucucuauaucaacaggaucccgaucagccaggucagcaauugaagaccuucucuuugacaaaguuaccauugccgauccaggcuauaugcagggauacgacgacuguaugcaacaagguccagcaucugcaagagacuuaauaugcgcucaauauguagcaggauacaaagugcuaccaccauuaauggauguaaauauggaagcagcuuacacaucuucccuauugggaucuauagccggugucggauggaccgcaggacucaguucauuugcugccauacccuuugcucaaucgauauucuacagacuuaacggagucggcauaacucaacaaguucucucagaaaaucaaaaauuaauagccaauaaauucaaucaagcauuaggugcgaugcagaccgguuucacaacaacaaacgaggcuuucagaaaaguacaagacgccguaaauaauaaugcacaagccuuaaguaaacuagccuccgaacuuucaaauaccuuuggcgcgauuucugcuucaauaggagacauaauacaaagacuugacguucuggaacaagaugcucaaauagaccgccucauaaacgggcgacuaaccacauugaaugcauuuguagcccagcaauugguccggucagaaucugcagcccuuuccgcacaacuugcaaaagauaaagucaaugaauguguaaaagcucaaucaaaacgcucaggcuucugcggucaagguacccauauagucucauucguaguaaacgcacccaauggacuauauuuuaugcacgucgguuacuauccuucuaaccacauugaaguaguauccgccuacggacuuugugaugcugccaaucccaccaauuguauugcgccaguaaaugguuauuuuaucaaaaccaauaacacacguauaguagacgaauggucauacacaggguccucauucuauaguccugaaccaauaacgucauuaaacacuaaauaugucgcaccccaagugacguaucaaaacauaucaaccaaucuaccuccuccccuccugggaaacucaacaggaaucgacuuccaagacgaacucgacgaguucuuuaagaaugucucuaccagcauacccaauuucggcucacuaacucaaauaaacacuacucuacuagacuuaacauacgaaaugcuaucucuucaacaaguagucaaagcucucaaugaaaguuauauagaccuaaaagaacuaggaaauuauacauacuauaacaaauggccaugguacaucuggcuaggauucaucgcaggauuaguugcuuuagccuuaugcguauuuuucauauuauguugcaccgguuguggaaccaauugcaugggcaaauuaaaauguaaucgcugcugcgauagauacgaagaauaugacuuagaaccccacaaaguacacguacacuag

SEQ ID NO: 1087 - RNA, 4062 nt, Artificial Sequence
  derived and/or modified CDS sequence (opt6) from MERS-CoV__AIY60558__S
augauacauucugucuuccuucuaauguuucuauuaacuccuacggaaucuuacguugauguagggccugauagcuuuaagucagcauguauagaaguugacauacaacaaacuuucuucgauaaaacauggccuagaccaauagaugugucuaaagcugacggcauuaucuauccacaaggcagaaccuauucaaauauuaccauuacuuaucaaggccuauucccuuaucaaggugaccauggcgauauguauguuuauagugccggccaugccacaggaacaacaccucaaaaauuauucguugcaaacuauagccaagauguuaaacaauuugcaaacggcuuuguaguaaggauaggagcugcugcaaauucaacggguaccguuauaaucucaccaaguacaucugcgaccauuagaaaaaucuacccugcauucaugcuaggaucaucuguuggcaauuuuagugauggaaaaaugggaagauuuuucaaucauacacuuguuuuacucccagacggcugcgguacauuauuacgcgcauuuuacuguauuuuagaaccacgaucaggcaaucauugcccagcaggcaauucuuauaccagcuuugcaacguaucauacgccugcaacagacugcuccgacggcaauuacaacagaaaugccucacuuaauucauucaaagaauacuucaaucuacguaacuguaccuuuauguacacauauaauaucacagaagaugaaauucucgaaugguucggaaucacucaaacggcacagggaguucaucuuuucagcucgcgcuacguagacuuauauggcggaaauauguuucaguuugccacucuuccagucuaugauacaauuaaauauuacucuauaauuccacacuccauccgaucaauacaaucugauagaaaagcaugggcugcauuuuaugucuauaaguuacaaccucucaccuuucuuuuagacuuuucaguagauggauauauacguagagcuauagacugcggcuuuaacgaccugagucaauuacacuguagcuaugaguccuuugacgucgaaucaggcgucuacucaguaucuucauucgaagcaaaaccaucaggaagcguuguagaacaagcagaaggaguagaaugugauuucucgccuuuacuaucgggaacacccccgcaaguuuauaauuuuaaacgccuaguuuuuacuaauugcaauuauaaucuaacaaaauuauuaucucuuuucuccguaaaugacuuuacauguucucaaauaucaccagcagcaauagcuucaaacugcuauucaagucuaauccuggauuauuuuucauacccauuaucaaugaaauccgaucuaucaguauccucugcuggcccaaucagccaauucaacuauaaacaaucauucucaaauccaacgugccuaauuuuagcaacagucccucacaaccucacaaccauuacaaaaccauuaaaauauagcuacauaaacaaaugcucuagauuacuaucugaugauaggacugaagugccacaacugguaaaugcaaaccaauauaguccauguguaucaauaguaccuagcacaguaugggaagacggcgauuauuaucgaaaacaacuuuccccauuagaaggaggaggcuggcucgucgcaagcggaucaacuguugccaugacugaacaauugcaaaugggauucgguauaaccguccaauauggaaccgacacaaauuccgucugucccaaauuagaauuugcaaacgacaccaaaaucgcaucacagcuugggaauugcgucgaguauucucuauacgguguauccggaagaggaguauuucaaaauugcacagcagucggaguaagacaacaacgcuuuguauaugacgcauaccaaaaccuuguaggauacuauucagaugauggaaacuauuauuguuuaagagcaugcguauccguucccguaucaguaauauaugauaaagaaacaaaaacucaugccacguuauucgguagugucgccugugaacauauuaguucaacaaugucucaauauucuagguccacacgaucaaugcucaaacgacgugauucuacauacgguccucuucaaacaccaguugguuguguacuaggccuuguuaauuccucccucuucguugaagacuguaaacuuccccucggucagucccuaugugcgcugcccgauacuccaucaacacuuaccccaagaucaguaagauccguucccggugaaaugcgacuagcaucaauagcauuuaaccacccaauccaaguagaccaauuaaauuccucauacuucaaauuaucaauacccaccaacuucagcuucgguguaacucaagaauacauacaaacaacuauucaaaaaguuacaguagacugcaaacaguauguauguaauggcuuucaaaagugcgaacaacuccuuagagaauacggccaauucuguucaaaaauaaaucaagcauuacacggugcuaaccuaagacaagacgacaguguaagaaauuuauuugccucagugaaauccucacaauccucaccuauaaucccaggcuucgguggcgacuucaaucuaacccuacuagaaccuguaaguaucaguacagguagccguucugcucguucagcaauugaagauuuauuauuugauaaaguaacgauagcagauccugguuacaugcaaggauaugaugacuguaugcaacaaggaccggccucggcccgagaucuuauuugugcacaguauguggccggauauaaagucuuaccaccucucauggauguuaauauggaagcagcauauacuucaucacuauuaggcucgauagcugguguaggauggacagcaggucuuaguucguucgcagcaauaccauucgcccaaaguauauuuuauagacuaaacggaguuggaauaacucaacaaguuuuauccgaaaaccaaaaauuaauugcaaacaaauucaaucaagcccuuggcgcaaugcaaacuggauucacgaccaccaacgaagcauuucgcaaaguccaagacgccguaaauaauaaugcacaagcucuaucuaaacucgcauccgaauuaucuaacacuuuuggcgcuauaucagcaucaaucggagauauuauucaacgcuuagacguauuggaacaggacgcacaaaucgaucgcuuaauuaauggcagauugacaaccuugaaugcuuuuguugcccaacaacucguuagaucagaaagugcagcacuaucugcccaacuagcaaaagacaaaguaaacgaguguguuaaggcacaaucaaaacguucuggcuuuuguggccaaggaacccacauagucagcuucgucguaaacgccccuaacgggcuuuauuucaugcacguuggauauuauccaucaaaucauauagaaguugucucugcauauggacuaugcgaugcagcuaacccaacaaauugcaucgcuccuguaaaugguuacuuuaucaaaacaaacaauacacgaaucguagacgaauggucauauacuggaucuucauuuuacaguccugaaccuaucacaucauugaacacaaaauacguagcuccacaaguaacauaucaaaacaucucaacuaaucuuccacccccauuauuagguaauucaacaggaauugacuuucaagaugaacuagacgaauuuuucaagaauguaucaacaucaauuccaaauuucggcucauuaacccagauaaauacuacacuacucgauuuaacauacgagaugcuaucccuacaacaaguaguaaaagcacuaaaugaguccuauauagaccuaaaagagcuagguaacuauacauacuauaauaaauggccaugguauauauggcuuggauuuauagccggauuaguggcacuugcccucuguguauucuuuauauuaugcuguacgggcuguggcacaaauugcauggguaaacuaaaauguaaucgcuguugugacagauaugaagaauacgauuuagaaccacauaagguacacguccacuag

SEQ ID NO: 1088 - RNA, 4062 nt, Artificial Sequence
  derived and/or modified CDS sequence (opt6) from MERS-CoV__AIZ74450__S
augauucauaguguauuucuacuuauguuuuuacucacuccaacagaauccuacgucgauguaggccccgacucuguuaaaucugcuugcauugaaguugauauccaacagacauuuuucgauaaaaccuggccacgcccaauugacgucaguaaagcugauggcaucauuuacccacaagguagaaccuauaguaacauaacaauaacauaucaaggguuauucccauaucaaggagaucacggugauauguacgucuacagcgcaggacaugccacaggaacuacaccacaaaaacuauuuguagcaaacuauucacaagaugucaaacaauuugccaauggauucgugguaagaauuggagcagcagcuaacucaacugggacagucauaauuucgccaucaacaagcgcaaccauaagaaaaauauauccugccuucauguugggauccucagugggaaacuuuucagaugguaaaaugggccgauuuuucaaucauacucuaguauuacuuccagauggaugcgguacacuacuacgagcuuucuacuguauauuagaaccuagaucuggaaaccacuguccggcuggaaacuccuauacaucuuuugcuacuuaccauacaccagcaacagauuguucugacggaaauuacaaucgaaaugcaagccuaaauagcuuuaaagaauacuuuaaccugcguaauugcaccuucauguacacauauaauauaacagaagaugaaauauuagaaugguucggcauaacacaaacagcgcaaggaguacaucucuuuucaucuagauauguagaccuuuaugguggaaacauguuccaauucgcgacccucccuguauacgauacuaucaaauacuauaguaucauaccccauaguauucgauccauacaaagcgaucguaaagcaugggcagcauucuacguauauaaacuacaaccuuuaacauucuuacuagauuuuaguguggaugguuacauccgacgcgccaucgacugcggauuuaaugaccuaucacagcuccauugcagcuacgagagcuucgacguugaaaguggaguauauuccguaaguucauuugaagcaaaacccuccggaucaguaguugaacaagcagaagguguagaaugcgauuuuuccccucuauuaucaggaacuccuccucaaguuuacaauuuuaaaagauuaguuuuuacuaauugcaacuauaaucucacaaaauuauuaucucuauucucaguuaaugauuucacgugcucucagauuaguccagcagccauugcaucaaauuguuacucaucccuuauucuagauuauuuuucauaucccuuaucuaugaaaucagaucuaaguguuaguuccgcaggcccuauaucacaauuuaauuauaaacaaucuuucucaaauccaacaugucuaauauuagcaaccgucccacacaaccuaacaacaaucacaaaaccgcucaaauacagcuacauaaauaaauguucacgacuuuuaagugacgaucguacugaaguuccccaacuuguaaacgccaaucaauauucacccugcgucucgauuguuccaucaacugucugggaagacggagacuacuacagaaaacaauuaucuccucuugaaggugguggaugguuaguagccucgggaucuacuguagcaaugacagaacaauuacaaaugggguuuggaaucacaguccaauaugguacagacacaaacucagucuguccaaaauuagaauuugcuaaugacacaaaaauagccucccaauuagguaacugcguagaauacucucuauacggaguauccggaaggggaguauuucaaaacugcacagcagucggaguuagacaacaacgcuuugucuaugaugcauaucaaaaccuagucggguauuauucugacgauggaaauuauuacugcuuaagagcauguguaagcguacccguauccguaauauaugauaaagaaacaaaaacacacgccacacuauuuggaagugucgcaugugaacacauaucuuccaccaugucacaauauucacgauccacaagaucaaugcuaaaacgaagggacaguacuuauggcccccuacaaacaccuguugguugcguacuugguuuagucaacucgucuuuauuuguugaagauugcaaauuaccacucggucaaucccucugugcuuuaccagauacuccaucuacucucaccccuagaucuguaagaaguguaccaggagaaaugagacucgcauccaucgccuucaaccacccaauacaaguugaucaacuaaauucuucauauuuuaaacucucaauaccaacuaacuucagcuucggagucacacaagaauauauacaaaccacaauacagaaaguuaccguugauuguaaacaauacguauguaacgguuuucaaaagugugaacagcuacuuagagaauacggacaauucuguuccaaaauaaaucaagcauuacacggcgcaaauuuaagacaagaugacucaguccguaaucucuucgcauccguaaaaucuagccaaaguucaccgauaaucccuggcuuuggcggcgacuuuaaccuuacucuucuagaacccguaagcaucucuacuggaagucgaucugcuagaagugcaauugaagaccuucucuuugauaaaguuacuauugcagauccuggauauaugcaaggauacgacgacuguaugcaucaaggaccagcauccgcaagagaucuaaucugugcccaauauguggcgggauauaaaguuuuaccaccccuuauggaugucaacauggaagcugcuuacacauccuccuuauuaggaucaaucgccggcguaggauggacagccggacuaucuucauuugccgcaauacccuuugcucaauccauauuuuauagauuaaauggugucgguaucacacaacaaguucuaagugaaaaucagaaauuaauugcaaauaaguucaaucaagcauuaggugccaugcagacuggauuuaccacuacuaacgaagcauucagaaaaguacaagacgcuguaaauaacaacgcucaagcccuuucaaaauuggcaucagaacuaucaaacacauucggugcaauuucggcaucaaucggagauauuauucagcggcucgauguucuagaacaagaugcacaaauugaucgucuuauuaacggaagauuaacuacuuuaaacgcauuuguagcccaacaauuaguaagaucagaauccgcagcucuaucagcacaacuugcuaaagacaaaguaaacgaaugcgucaaggcacaaucuaaaagaucuggauuuugcggucaagguacucauaucgucucuuuuguugugaacgcaccuaauggguuguacuucaugcauguugguuacuacccuucaaaccauauugaagucguuucagcuuacggauuaugcgaugcugccaauccuacuaacuguauugcaccugucaacgguuacuucauaaaaacaaacaacacucgcauagucgacgaauggaguuauaccggaaguuccuucuauucuccugaacccauaaccucguuaaacacgaaauauguugcaccccaaguaacauaucaaaacauaaguacaaaucuaccaccuccccuacuuggaaacucaacaggaauugauuuucaggacgaacuagaugaauuuuucaaaaacguuucaacuucaauaccuaauuucggaucccuaacccaaauaaacaccacgcugcucgaccuuacuuacgaaaugcuuucacuacaacagguaguaaaagccuuaaaugagucuuacauugaccucaaagaauuaggaaacuauaccuauuauaauaaauggccuugguauauauggcucggauuuauugccggacucguagcuuuagcccuguguguauucuuuauauuauguugcaccggcuguggcacaaauuguaugggaaaauuaaaauguaauagaugcugugaccguuaugaagaauaugauuuagagccacauaaagugcauguccauuag

SEQ ID NO: 1089 - RNA, 4062 nt, Artificial Sequence
  derived and/or modified CDS sequence (opt6) from MERS-CoV__AJD81440__S
augauacacuccguuuuucuacuaauguuucuacuaacaccaaccgaaucuuauguagauguagguccugauagcgugaaaagcgccugcaucgaagucgauauacaacaaaccuucuuugauaaaacuuggccaagacccauagacgucuccaaagcugacggaauaaucuacccccaaggucggacauauagcaauauuacuauaacuuaccaaggacuuuucccauaucaaggcgaucauggagauauguacguauacucugcuggacaugccacaggaacaacuccacaaaaacuuuucguggcaaauuauucacaagauguuaaacaauuugccaauggauucguugugagaauuggugcggccgcaaacuccacuggaacaguuauaauuaauccaucaacaagcgcaacuauucguaaaauauauccugcuuuuauguuaggauccucuguagguaauuuuagcgauggcaaaauggguagauucuuuaaccauacacuuguauuacuuccugaugguugcgguacacuauuacgagccuucuauuguauuuuagaaccucguucaggaaaccacugcccagcaggcaauucuuauaccucauuugcuaccuaucacacaccagcaacugauuguucagaugguaauuacaaucgcaacgcuucucuuaauaguuuuaaagaauauuucaauuuaagaaacuguacuuuuauguacaccuauaauauaacagaagaugaaauacuagaaugguucggcauaacucaaacagcgcaaggaguacacuuauuuuccucacgauauguagaucuguauggcgggaacauguuucaauuugcuacucuaccagucuacgacacaauuaaauauuauucaaucauaccucauaguauucgaucuauacaaucagaccgcaaagccugggcagcuuuuuacguuuacaagcuacaaccucuuacauuccuccucgacuuuucagucgauggcuauauuagacgagcuauagauugcgguuuuaacgaccuaucgcagcuacauuguuccuaugaauccuucgauguagaaagugguguauauuccguaagcaguuuugaagcuaaaccaucugguucaguaguugaacaagcugaaggaguagaaugugauuucucaccauuauuaucaggcaccccuccucaaguauacaauuucaaacgucucgucuuuacuaacuguaauuauaaucuuacaaaacuacugucucuauuuuccguaaaugauuuuacaugcucacaaauauccccugcggcaauagcuucaaauuguuacagcagcuuaauauuagacuauuuuucuuauccacuuuccaugaaauccgaccuuucaguaucuucagcagguccaauaagucaauuuaauuacaaacagucauuuucaaauccaacaugucuaauuuuggcaacugucccucauaaucuaacuacuauaacaaaacccuuaaaauauucauauauaaacaagugcagcagacucuuaucagaugaccgcacugaaguaccacagcuugucaacgcaaaucaauauucaccuugcgugaguauuguaccaucaacugucugggaagacggagacuauuacagaaaacaauuaucaccccuagaggguggagguuggcugguugcuucagguagcacagucgcuaugacagagcaguuacaaaugggcuuugguauaacaguucaauacgguacagauaccaauuccguguguccuaaacuagaauuugcaaaugauacaaaaauagcuucacaacuaggaaacuguguugaauauucacuauauggaguuucaggaagaggcguuuuccaaaauuguacugcugugggcguuagacaacaacguuucguuuacgaugcauaucaaaaccucguaggauacuauuccgaugacggaaauuacuacugccuucgagcaugcguuucaguacccgucucaguaauauacgacaaagaaaccaaaacacaugcaacucucuucggcuccguugcaugcgaacacauauccucuacuaugucacaauacucacggucaacuagaucuauguuaaaacguagagauuccacauauggcccauuacaaaccccugucggauguguuuuagguuuaguaaacucaucucucuuugucgaagacugcaaacuuccacuuggucaaucacucugcgcauuacccgauacaccaaguacauuaacaccacgauccguacgaagugucccaggcgaaaugcgcuuagcaucaauagcauucaaucauccuauucaaguugaucaacucaacucuuccuauuuuaaacuuucuaucccaaccaauuucucuuucggcguuacacaagaauauauucaaaccacaauacaaaagguaacggucgauugcaaacaauacguauguaacggauuucaaaaaugugaacaacuucucagggaauauggacaauucuguucuaaaauaaaccaggcuuuacauggugcaaacuuacgacaagaugauuccgucaggaaucuauuugcgucaguaaaaucgucacaauccucaccuauuauaccgggauuuggcggugacuucaacuuaacacuuuuagaacccguuucuaucuccaccggaagcagaucugcaagaucugcuaucgaagaccuccuauuugauaaaguaacaauagcagacccaggauauaugcaagguuaugaugacuguaugcaacaaggcccagccucagcucgugacuuaaucugcgcacaauauguagcuggauauaaaguuuuaccaccccuuauggaugugaauauggaagcagcauauacuucaagccuauuagguagcaucgcaggcguuggcuggaccgcuggauugucauccuucgccgcaauccccuuugcacaaucuauauucuacagacuaaacggggucggaauuacacaacaaguauuauccgaaaaucaaaaauuaauagcuaauaaauuuaaucaagcacuaggagcaaugcaaacagguuuuacaacaaccaacgaagccuuccgaaagguccaagacgcaguuaauaacaaugcacaagcucuuucaaaacucgcuucagaacucucaaauaccuuuggcgcaauaucugcaucaauaggagauauuauacaaagguuagauguuuuagaacaagacgcacaaaucgauagauuaauaaauggccgacucacaacuuuaaacgcuuucguagcacaacaauuggugcgaucagaauccgcugcacuuuccgcacaacuagcgaaggacaaaguuaaugaauguguaaaagcgcaaaguaaacgcucaggcuuuuguggacaaggaacacauauaguuucauuugugguaaacgcaccuaauggucuauacuuuaugcaugucggauacuauccaucuaaccauauagaaguaguuuccgcauauggucucugcgaugccgcaaauccaaccaauuguauugcaccugucaaugguuacuuuauaaaaacaaauaauaccagaauaguagaugaauggaguuauacuggaagcucauucuaugcccccgaaccaauaacaucccuaaacacaaaauacgucgcaccucaaguuaccuaucaaaauauuucgacuaauuuaccuccaccucuacuaggaaauucuaccggaaucgauuuucaagacgaacucgaugaauuuuucaaaaauguuaguacaucuauacccaacuucggcuccuuaacgcaaaucaauacaacacuuuuagaucucacauacgaaaugcuaucgcuacaacaaguaguaaaagcccuaaaugaaucauauauugaucuaaaagaacucgguaauuacaccuacuacaacaaauggcccugguacaucuggcuaggguuuauagccggauuaguugcacuagcucucugcguauucuuuauauuauguugcacgggaugcgguacaaacuguaugggcaaacuaaaaugcaaccguuguugugaccguuaugaagaauaugaccuugaaccacacaaaguccacguccauuaa

SEQ ID NO: 1090 - RNA, 4062 nt, Artificial Sequence
  derived and/or modified CDS sequence (opt6) from MERS-CoV__AKI29284__S
augauccauuccguuuuucuauuaauguucuuauuaacuccuacagaauccuacguagauguuggacccgacagugucaaaagcgcaugcaucgaaguugacauacaacaaacauucuuugauaagacauggccaagaccaauagauguauccaaagcagacgguauaauauacccacaaggaagaaccuacucaaacauaacaauaacauaccaaggauuauuuccauaccaaggcgaucauggggacauguauguuuauuccgcagggcaugcuacugguacaaccccacaaaaacuuuucguugcgaauuauucccaagauguaaaacaauuugcuaaugguuucgucgucagaauuggagcagcagcuaauuccacaggcaccgucaucauaucuccaaguacuuccgcaacaauccgcaaaauuuauccagccuucaugcucgggucaucuguaggaaauuucagugaugggaaaaugggaagauucuuuaaccauaccuuaguacuucuuccagacggcuguggcacucuauuaagagccuucuauuguauauuagaaccacguucaggcaaucacuguccagcagguaauagcuauacaucauucgcaacauaccacaccccagcaacugacuguagugauggaaacuauaaccgaaacgcaagucucaacuccuuuaaagaauauuuuaacuuaagaaacugcaccuuuauguauacuuacaauauaacagaagaugaaauacuagaaugguucgguauaacacaaacugcacaagggguucaccuuuuuagcucaagauauguugaccuauauggcggcaacauguuucaauucgcaacacuuccuguauaugauacuauaaaauauuacucaaucaucccacauaguauaagaucuauucaaucagaucgaaaagccugggccgcuuucuauguuuauaaauugcaaccacuuaccuucuuacuagacuuuuccgucgacggauacauccgacgcgccauagacugcggauuuaaugacuuaucacaacuucauugcucauacgaaucauuugacguugaaucuggcgucuauagcgucucaucauuugaagcaaaaccaucuggcucuguagucgaacaagcugaagguguagaaugcgacuucucaccauuacuuucaggaacgcccccacaagucuauaauuucaaacgauugguauucacuaauugcaauuauaaccuaacaaaacuacuaucacuauuuagugucaacgauuucaccuguucucaaauaagccccgcugcaauagcaucgaacuguuauucuucacucauacuagacuauuuuuccuauccauuaucgaugaaaucagaucuuucaguuucaucagcaggaccaauaucacaauucaacuauaaacaaucauuuuccaauccuacaugucuaauucuugccacuguuccacauaaucugaccacuauaacaaaaccucuaaaguauucuuacaucaacaaauguucccgucuacucucagacgaucguacagagguaccucagcuagucaacgccaaucaauacagucccugugucucgauaguaccuucaacugucugggaagacggagacuauuauagaaaacaauuaucaccauuagaaggaggagguuggcuuguugcguccggaucuacaguagcaaugacagaacaauugcaaaugggauucgguaucacuguucaauacggaacugacaccaauucaguaugcccaaaacuagaguucgcaaacgauacaaaaauugcaucacaacuggguaauugcgucgaauauagccuuuauggggucucuggucgaggaguuuuucaaaauuguacagccguaggcgugagacaacaaagauucgucuacgacgcuuaucagaaucuaguuggauauuauagugaugacggcaacuauuacugucuucgagcuugcguaucagucccgguuucaguaauauaugacaaagaaacuaaaacucaugcaacacuuuucggaucuguagccugugaacacauaucaucuacaaugucacaauacucacgaucaacucgguccauguuaaaacgucgagacuccacauacgguccacuacaaaccccagucggaugcguacuuggucuuguaaacucaucguuauuuguugaagauugcaagcuaccacucggacaaagccuuugugcacuacccgauaccccaucuacacucacacccagaucaguuagaucaguaccuggugaaaugcgacuagcaucaauagcuuuuaaccauccaauacagguagaccaacuaaacagcucauacuucaaguuauccauaccaacuaauuuuucauucggcguaacccaagaauauauacaaacuaccauacaaaaaguaacaguagacuguaaacaauauguaugcaaugguuuccaaaaaugugaacaauuauuaagagaauacggacaauuuuguagcaaaaucaaucaagccuuacacggagcaaaccucagacaagacgacuccguucgcaacuuauuugcuucaguaaaaaguucacaaucaaguccaauuauuccuggauuugguggagauuucaauuuaacucuacucgaaccaguaucuaucucgacuggaucaagaucagccagaagugcgaucgaagaucuauuauuugacaaaguaacuaucgcagauccuggauacaugcaaggcuaugaugacugcaugcaacaaggaccugcaagugcacgggaucucaucugcgcucaauacgucgcugguuauaaaguacuuccaccauuaauggauguaaauauggaagccgcguacacaagcuccuuauuaggaaguauugcgggugucggcuggacugcaggguuauccucauucgcagcaauaccuuucgcacaauccauauucuaccgacugaauggugucgguauuacucaacaaguucugucagaaaaucaaaagcuaauagcaaauaaauucaaccaagcacuaggcgcaaugcaaaccggauucacaacgacuaacgaagcauuucguaaaguacaagaugcaguaaauaacaacgcacaagcauuaucuaaacucgcaagugaacuuagcaauacauuuggugcaaucucugcaagcaucggagauauaauucaaagauuagacguuuuagaacaagacgcacagauugacagauuaauaaacggaagguuaacuaccuuaaaugcauuuguagcucaacaacuuguacguucagaauccgccgcuuuaucugcacaauuagcuaaagacaaaguaaaugaauguguuaaagcccaaucuaaacgcucaggcuucugcggacaaggaacucauaucgucuccuuugucguaaaugcaccuaauggcuuauauuuuaugcauguaggcuauuauccaucuaaucacauugaaguuguaagcgcuuacggcuuaugcgacgcagcuaaccccacaaauugcauugcaccaguaaauggauacuuuauuaaaacuaauaacacucguauuguggacgaauggucauacaccggcaguuccuuuuacgcuccugaaccaaucacuucauuaaacaccaaauauguugcaccacaaguuacauaccaaaauaucuccacaaauuuaccuccaccguuacuagguaauuccacaggcauagacuuucaagaugaacuugacgaguucuucaaaaauguuuccacaucaauucccaauuucggaucguuaacacaaauuaauacuacacuguuagacuuaacauaugaaaugcuaucccugcaacaaguuguaaaagccuuaaacgaaaguuauaucgacuuaaaagaacuugguaauuacacauauuauaacaaauggccuugguauauauggcuagguuucauugccggucugguggcacuagcacuaugugcauucuuuauauuaugcuguacaggcugcgguacaaacugcaugggcaaacucaaauguaaccguugcugugacagauacgaggaauaugaucuugagccccacaaaguacacguccacuaa

SEQ ID NO: 1091 - RNA, 4062 nt, Artificial Sequence
  derived and/or modified CDS sequence (opt6) from MERS-CoV__AKL59401__S
augauacacaguguauuccuguuaauguuuuuacuaacacccaccgaaucauauguugaugugggaccugauagcgugaaaagugccuguaucgaaguagacauacaacaaacuuucuuugacaaaacauggccuagacccauugacgucuccaaagcagauggaauuaucuacccacagggacgaacuuacucaaauaucacaauaacauaucaaggauuauuccccuaccagggagaucauggagauauguauguauacucugcgggacacgcuacgggaacgaccccacaaaaauuauuuguugccaacuauucucaggacgucaaacaauuugcaaacggauuugugguucguaucggagcggcagcaaauuccacaggaacuguaauaauaucaccguccacccgagccacaauccgaaaaauauauccugccuuuaugcucggaucaucaguuggaaacuuuucugauggaaaaauggguagauuuuucaaucauaccuuagugcucuugccagauggauguggaacauuauuaagagcauucuauuguaucuuagaaccaagauccggaaaucacugcccagcuggaaauucauacacaucauuugcuaccuaucacacuccagcaacagauugcucagacggaaacuacaacagaaaugccucauuaaauucauuuaaagaauauuucaacuuaagaaauugcacguuuauguauaccuacaauauaacagaagaugaaauauuagaaugguuuggcaucacacaaacugcccagggaguucauuuauucucaaguagauacguagauuuauauggaggaaacauguuucaguuugcuaccuuaccaguuuaugauacuauaaaauacuacucaauuaucccucacuccauuagaucaauacaaucugauagaaaagccugggccgccuucuacgucuauaaacuucaacccuuaacuuuccuucuagauuucucugucgauggcuacauacguagagcaauagauuguggcuucaacgaucuaucccaacuacauuguucuuacgaaucauucgacgucgaaucuggaguguacucuguaucuucauuugaagcuaagccaucuggaucuguugucgaacaagcagaaggaguagaaugcgauuuuuccccauuauuaucuggcacacccccucagguauauaacuuuaaaagauuaguuuucacuaauugcaauuauaauuuaacuaaacuucuaucauuauucagcguaaacgauuuuaccugcagucaaaucucaccagccgcaauagcaagcaacuguuauucaagucuaauacucgauuauuucaguuacccacuaucgaugaaauccgaucucucuguuucauccgcgggacccauaucucaauuuaauuauaagcaauccuuuaguaauccaaccugucugauuuuagcuacaguaccacauaauuugacuacaaucacuaaaccccuuaaauacucauauauuaauaaaugcucacgauuacuuucugaugauagaaccgaagucccacagcuaguuaaugcgaaccaauacucccccugcgugucaauauuaccuaguaccguuugggaagacggagacuauuacagaaaacaauuauccccauuagaaggcggaggaugguuagucgcuagugggucaaccgucgcuaugaccgaacaacuacagauggguuuuggaauaacuguacaauauggaacugacacaaauaguguuugucccaaacuagaauuugcaaacgauacaaaaauagcaucucaauuagggaauuguguagaauauucucuuuacgguguuaguggacgaggcguauuccaaaacuguacagcuguaggaguacgacaacaacgcuuugucuacgacgcguaccaaaaccuugucggauauuauucagacgauggaaauuacuacuguuuacgugcaugcguaucaguaccaguaucuguaauuuaugauaaagaaacaaagacgcacgcaacauuauuuggauccguugcaugcgaacauauaucaucaacaaugagccaauacucuagaucuacaagauccauguuaaaacgcagagacuccacauacggcccacuucaaacaccggucggaugcguacuaggccuagucaacucauccuuauuugucgaagauuguaaacuucccuuaggacaaucauuaugugcccuaccagauaccccaaguacuuuaacgcccagaucaguucguaguguccccggcgaaaugagacuugcuucaaucgcauuuaaccauccaauucaaguggaccaacuaaauucaucauacuucaaacucucaauucccacuaacuucuccuuuggaguuacucaagaauacauacaaacaaccauacaaaaaguaaccguagauugcaagcaauaugucuguaauggauuucaaaaaugcgaacaacucuuacgagaguauggucaauucuguucaaaaauaaaucaagcauuacacggagcuaaccuacgacaagacgauucaguccgaaaucuauuugcauccguuaaaucuagucaaucaucuccgaucauacccggauucgguggagauuuuaacuuaacacugcuagaaccagucucuauuucaacaggaucacguuccgcaagaucagcuaucgaagauuuauuauucgacaaaguaacuaucgcagauccugguuauaugcaagguuacgaugacuguaugcaacaaggaccugcguccgcacgugaccuaauaugugcacaauauguagcaggauacaaagugcuaccuccuuugauggauguuaacauggaagcagcuuacacaucuucacuacuuggaucuaucgcggguguaggguggacagcuggauuaucaucuuuugcagcaauuccauuugcucaauccauauuuuacagguuaaauggcguuggaauuacccaacaagucuuauccgaaaaccaaaaauugauagcuaacaaauucaaucaagcauugggagcaaugcaaacaggauuuacuacuaccaacgaagcauuuagaaaaguucaagaugcgguuaacaauaacgcacaagcucuaagcaaacuagcuucugaauuaucaaauacauucggagccauuucagccucaauaggugacauuauacaacgacuagacguacuugagcaagaugcacaaauagaccgccuuaucaauggaagauugacaacacuaaacgccuucgucgcacaacaacugguucgaucagaaucagcugcauuaagugcacaauuagccaaagacaaaguaaacgaaugugugaaagcacaauccaaacguucgggcuucuguggccaagguacccauauaguaucuuucgucguaaaugcaccuaacggacucuacuuuaugcacguaggcuauuauccaucaaaccauauagaagucguaucagcauacggauuaugugacgccgcaaauccuacaaacuguaucgcaccaguaaacggauacuuuauaaaaaccaauaauacucgaauaguagacgaguggucauauacugguaguucuuucuaugccccugagccuauaacaaguuugaauacuaaauacguugcuccucaaguuacauaucaaaauauuucuacaaaucuacccccaccacuauuagguaacucuacagguauugacuuucaagacgaauuagaugaauuuuucaaaaauguauccacaucgaucccuaauuuugguuccuuaacacaaauaaauacaacacuacuugaucuaacuuaugagauguugucuuuacaacaaguaguuaaagcauuaaacgaaucauauauugauuuaaaagagcuagguaacuauacauacuacaacaaauggccaugguauaucuggcucggauuuauugccgggcuuguugcauuagccuuaugugucuucuuuauccucugcuguacaggcuguggaacaaacugcauggguaaacucaaauguaauagguguugugaucgcuacgaagaauacgauuuggaaccccacaaaguacacguccacuaa

SEQ ID NO: 1092 - RNA, 4062 nt, Artificial Sequence
  derived and/or modified CDS sequence (opt6) from MERS-CoV__AKM76229__S
augauacacucagucuuccuacuuauguuuuuacucacccccacagaaucuuacgucgaugucggucccgauaguguaaaaucagcauguauagaaguugacauacaacaaacuuucuuugacaagaccuggccucgcccaauagauguaaguaaagccgacggaaucauauauccacaagguagaacauauaguaauauaaccauuacauaucaaggauuauuuccuuaucaaggugaccauggugauauguacguauauucagcaggacacgcuacaggcacaacaccacaaaaacucuuuguagcaaacuacucccaagacguaaaacaauucgcuaauggcuuuguuguacgaauuggagcagcagccaauucuacaggcacaguaauuauaucuccuucaacaagugcgacuauaagaaaaauauacccagccuuuauguuaggaucauccguuggaaacuuuagugauggcaaaaugggucguuucuuuaaucauacucuaguauuacuuccagauggaugcgggacucuguuacgagcauuuuacuguaucuuagaacccagaagcggcaaccauuguccagccgggaauagcuauacaucauuugccaccuaccauacuccugccaccgauuguagugauggaaacuacaauaggaaugcguccuuaaacucauuuaaagaauauuuuaaccucaggaauugcacauucauguauacauacaacauaacagaagaugaaauacuagaaugguucggaauaacgcaaaccgcacaaggaguucaucucuuuucaagucgauauguugauuuauaugguggcaacauguuucaauuugccacacuuccaguauaugauacaaucaaauacuacucaauaaucccacauaguauuagaucuauucaaucugauagaaaggcuugggcggcauuuuacguauauaaacuccagcccuuaacuuuucuccuugacuucucuguagaugguuauauaagacgcgcgauagauugcggauuuaaugacuugucccaauuacacugcucuuaugagagcuuugauguagaaucagguguuuauuccguuagcucauuugaggcaaagccaucuggcucagucguugaacaagcagaaggcgucgaaugugauuuuucaccauuacuuuccgguacuccuccacaaguauauaauuuuaaacgucuaguauucacaaauuguaacuauaaucuaacaaaauuauuaucacuauucagcguaaacgacuucacuuguagccaaauaucuccagccgcaauagcuagcaauuguuacucaucacugauucuagauuacuuuaguuacccucuaucaaugaaauccgaucuuucuguuagcucugccgguccaauuucccaauucaauuacaaacaaucuuucucaaauccaacaugcuuaauauuagcaacaguuccucauaaccuuacaacaaucacuaaaccuuuaaaauacagcuacauaaauaaauguucaagauuauuauccgaugauagaacagaaguaccucaauuagucaaugcaaaucaauauagcccuugcgucuccaucguuccuucaaccguuugggaagacggagacuauuaccgaaaacaacucagcccucuagaggguggaggauggcuuguagcgucuggaucaacaguugcaaugaccgaacaacuacaaaugggcuuuggaauaacaguacaauacggcacagauacuaacuccgucuguccaaaauuagaauuugcaaaugacacaaaaauagcuucucaauuaggaaauugugucgaauauucacucuaugguguaucaggaaggggaguauuucaaaauugcacagcuguuggaguucgucaacaacguuuuguuuaugacgcuuaucaaaaucuagucggauauuacagugaugacggcaacuauuauugucuacgugccugugucucagucccaguaaguguaauauacgacaaagaaaccaaaacacacgccacacuuuuuggaucuguagcaugugaacacauaagcuccaccaugucccaauauucaagaucaacuaggucaauguuaaaaagaagagauuccaccuaugguccacuacagacaccaguaggauguguacuuggcuuaguaaauucaucuuuauuugucgaagacugcaaacugccucuuggacaaucauugugugcguugcccgauacaccuuccccauuaacuccaagaucggugaggucgguuccaggagaaaugagacuagcaucaaucgcuuuuaaucacccaauacaaguagaccaauuaaacucaaguuacuucaaacucucaaucccaacuaauuuuagcuucggcguaacucaagaauacauacaaacaacaauccaaaaagucacaguagauugcaaacaauacauuuguaaugguuuucaaaaaugcgaacaauuacuucgagaauauggucaauucugcucaaaaaucaaucaagcccuacacggcgcaaaucuaagacaagacgauucaguaagaaauuuauucgccucuguaaagucuucccaaagcucuccuauaauaccgggauuuggaggagauuucaaccuuacacucuuagaaccagucaguaucagcacuggcucuagaucagcuagaagugccauagaagauuuacuauucgauaaagucacaaucgcagauccaggcuauaugcaaggauacgacgauugcaugcaacaagguccggcaucagcacgagaccugauuugugcacaauauguugccgguuauaagguacuucccccauuaauggauguaaauauggaagccgcuuauacuucuucacuauuaggaucaauagcaggaguuggauggacagcaggguuaucaucuuuugccgcaaucccauuugcccaaagcauauuuuaucgacuaaauggcgucggaauaacacaacaaguacuaucggagaaccagaaacuaaucgcuaacaaauuuaaucaagcacuaggagcaaugcaaacgggauuuacaaccacuaacgaagccuuuagaaaaguucaggaugcagucaauaauaacgcucaggccuugucgaaacucgcuuccgaacucucgaauacauuuggggcaauaagcgcaucaauaggugauauaauucagcgguuagauguacuggaacaagaugcccaaaucgaccgcuugauaaauggaagacuuacaacauugaacgcauuugucgcacaacaauuaguaagaagugagucagcagccuuaagcgcccagcucgcaaaagauaaagugaaugaaugcgugaaggcccaaucaaagagaucaggcuucuguggucaagguacacacauagugaguuucguagugaacgcccccaacggucuauauuuuaugcauguuggauauuauccuuccaaucauauugaaguaguaucagcuuacggucuaugugaugccgcuaacccaacaaacugcauugcucccgucaacggauauuucauuaaaaccaauaauacuagaauuguagaugaauggucuuauacggguucaucuuucuauucaccggaaccaaucacaucacuaaauacaaaguauguagcaccccaaguuacuuaccaaaauauaaguacaaaucuaccaccacccuuacuaggaaacucaacaggaauagauuuccaagacgaacucgacgaauuuuucaaaaacgugagcacaucaauuccuaacuuuggaucacucacccaaauaaauacaacauuacucgaucuaacauaugaaaugcuaucuuuacaacaaguugucaaagcccuuaacgaaucauacauagauuugaaggaauuaggcaacuacacuuacuauaauaaauggccaugguauaucugguugggcuuuauugccggucuuguugcacucgcacucugugucuuuuucauacuaugcuguaccggauguggcacaaauuguauggguaaacuaaaauguaauaggugcugcgauagguaugaagaauaugacuuagaaccacauaaaguucauguacauuaa

SEQ ID NO: 1093 - RNA, 4062 nt, Artificial Sequence
  derived and/or modified CDS sequence (opt6) from MERS-CoV__AKM76239__S
augauccacucaguauucuuauuaauguuucuucuaacuccgacggagucuuauguggaugucgguccagacucagucaaauccgcguguauagaggucgacauacagcagaccuucuuugauaaaacauggccccgcccaaucgacguaaguaaagcagauggaaucauauauccucaaggaagaacuuauucgaacauaaccaucacuuaucaaggucuauuucccuaccaaggcgaccauggugacauguaugucuacucugcaggacacgcgacagguacaacaccccaaaaauuauucguagcuaacuacucacaagaugucaagcaauucgcaaauggauucguaguacguaucggagcagcagccaacucuacuggcacggugauuauaagcccauccaccucagcaacuauccgcaagauuuacccugcauucaugcuaggcucaucaguagguaauuucagugauggcaaaaugggaagauucuuuaaccauacccuaguacuccuuccagacggcuguggaacacuucuaagagcauuuuacuguauucucgagccuagaucaggaaaccacugcccagccggaaauaguuauacaucauuugcaacauaccacaccccagcuacagacugcucagaugguaacuauaacagaaaugcaucacuaaacucauuuaaagaauauuucaaccuucgcaauugcacuuuuauguauacauauaauauaacagaagacgaaauacucgaaugguucggaauaacccaaacggcacaaggaguacacuuauuuagcucaagauacguagaccuauacggaggaaauauguuccaauuugcaacccuuccuguuuaugacacaauaaaauacuacucaauuauaccccauucaauucgcucaauacaaucagacagaaaggcuugggccgcauuuuauguuuauaaauuacaaccacucacauucuuacuagacuucucagucgacggauauauaagacgagcuauugacugcggcuucaaugaccuuucccaacuucacuguucguaugaaucauucgacguagaaucaggaguauauagugucucaucguucgaagcuaaaccaaguggcucaguaguugaacaagcugaaggaguugaaugcgauuuuucaccucuucuuucuggcacaccuccacagguauauaauuuuaaaagauuaguuuucaccaacuguaauuauaaucuuacaaaacugcuaucucuauuuaguguaaacgauuuuaccugcucucaaaucucucccgccgccauagccucaaauugcuacucuucacuuauacuagauuauuuuuccuauccacuuucaaugaaaagugaucuaucagugucuucagcaggccccauuucucaauuuaauuauaaacagaguuucaguaauccuacaugccuaauauuagcaacuguuccucacaauuuaacaacaauaacaaaaccauuaaaauacucauauaucaacaagugcagucgacuucucucagacgacagaacagaacuuccccaacucgucaacgccaaucaauauaguccuuguguuucaauugugccaucaacaguaugggaagauggagauuauuaccgaaaacaauuaucaccccuagaaggagguggaugguuagucgcaaguggaucuaccguagcuaugaccgagcagcuccagauggguuuugguauaaccguacaauauggaaccgauacuaacucaguuugcccaaaacucgaauuugcgaaugacacgaaaauagccagccaacuuggaaauuguguugaguacucacuauacggugucucugguagaggcguauuucaaaauuguaccgcaguaggaguuagacagcaacgauuuguauaugaugcauaccaaaaccuaguaggauacuacucagacgacgguaauuacuauuguuuaagagcauguguaucaguuccaguaucuguaauauacgauaaggaaacgaaaacucacgccacacuauucggcaguguggcaugugaacacaucucaucuacaaugagucaauacucacgaucaacgaggucuaugcuaaaacggcgagauucuaccuacggaccucuucaaacaccuguaggcugcguucuggggcuaguaaauucaucuuuguuuguggaagauuguaaauuaccccucggccaaucucugugcgcucuaccugauacuccaucaacucuuacgccaagaaguguucgcucggucccaggugaaaugagacucgccuccauagcuuucaaccacccuauacagguugaucaacuuaacucuaguuacuuuaaacucucaauaccaacaaacuuuuccuucgguguaacacaagaauauauccaaacaacaauccaaaaaguuaccgucgacuguaaacaauacauauguaauggguuccaaaaaugugaacaauuacuuagagaauacggacaauuuugcuccaaaauuaaucaagcacuacauggcgcaaaucuaagacaagacgacaguguucgcaaccuauuugcaucagucaaguccucacaaucaucucccauaauacccgguuucgguggugacuuuaauuuaacacuauuagaaccaguaagcauaucaacaggaucgcgaagcgcaagaucagcuaucgaagaucuucuauucgauaaaguaacaauagcugauccagguuacaugcaaggcuaugaugacuguaugcagcaaggaccagcauccgcuagagaucuaauaugugcgcaauacguugcagguuauaaagucuuaccgccauugauggaugucaauauggaagccgcuuauacaucuucacuuuuaggaaguaucgcaggaguagguuggaccgcaggauuaagcucauucgcagcuauuccuuuugcacaaucaauauuuuauagauuaaacggcguuggcauuacccaacaaguccuaucugaaaaucaaaaacucauugcaaacaaguuuaaccaagcacuaggcgcuaugcaaacaggauucaccaccacuaacgaggcauuuagaaaaguccaagaugcagucaauaauaacgcacaagcauuaagcaaauuagcaucagaauuaucaaauacauucggagcaauuucugcaagcauaggcgacauaauccaaagacuagaugugcuugaacaagaugcgcaaaucgaccggcucauuaauggcagacucacuacuuuaaacgcauuuguagcacagcaauuaguuagaucugaaucagcagcuuuaucagcacaacucgcaaaagauaaaguuaacgaauguguuaaagcacaaucuaaaagaucaggauuuuguggccaaggaacccauauuguuucauuuguuguaaacgcaccaaacggccuuuauuuuaugcaugucgguuauuaucccucaaaucauauugaagugguaucagcauauggauuaugcgauguagcaaaucccacaaauugcauagcaccagugaauggcuauuucauaaaaaccaacaacacacguauagucgaugaaugguccuauacaggauccuccuuuuacucuccagaaccaauaacuucacuuaauaccaaauauguagcuccacaagugacauaucaaaacaucucuaccaaccuaccuccuccucuacuagguaacuccacugguauagauuuucaagacgaacuagacgaguucuuuaaaaauuuuucuacuucaauucccaauuuuggcucacuaacacagauuaacacaacacuacuagauuuaaccuacgaaauguuaucgcugcaacaaguaguaaaagcacucaacgaaucauauauagaucuuaaagaacucgguaauuauacauacuauaauaaauggccaugguacauuugguuaggcuuuauagcaggacuuguagcccuagccuuaugcguauucuucauacucuguugcacaggaugcgguaccaacuguaugggcaaauuaaaaugcaauagaugcugugacagauaugaggaguacgauuuagaaccucacaaaguccauguucacuaa

SEQ ID NO: 1094 - RNA, 4062 nt, Artificial Sequence
  derived and/or modified CDS sequence (opt6) from MERS-CoV__AKN11072__S
augauacauaguguauuccuauuaauguuccuauuaacuccaaccgaaaguuauguagacguaggaccggacucagugaaaagugccugcauugaaguugauauacaacaaacauucuuugacaaaacauggccgagacccauugacguaagcaaagcagacgguauaauuuauccucaaggcagaacuuauucuaauauuaccauuacauaccaaggauuauuuccuuaucaaggugaucacggagacauguaugucuauucagcgggccaugcaacaggaacaacuccucaaaaacuauuuguagcgaauuauagucaagauguuaaacaauuugcaaacggauuuguaguucgcaucggugcugccgcaaacuccaccgguaccguaaucauaucaccgucaacaagugcaacaauacguaaaauuuacccagcauuuauguuaggaucgucuguuggaaacuucucagauggcaaaaugggacgguucuucaaucauacccucguucuauuaccugacggauguggcacucuacuucgcgcuuucuauugcauccuugaaccuagaaguggcaaccauugcccggccggcaacucauauacaucauucgccacguaucauacgccugcaacagacugcuccgaugggaauuauaaccgcaaugcaucucuaaauucuuuuaaggaauauuuuaacuugagaaauuguacauuuauguacacauauaauauuacugaagacgaaauacuagaaugguucggcauuacccaaacugcccaaggaguacauuuauuuaguuccagauacguagaccucuacgguggaaauauguuccaauuugcaacucuuccugucuaugacaccauaaaauauuauucgauuauuccucauucuauucgaucaauucaaagugauagaaaggcuugggcugcauucuauguauauaaacuucaaccccuaacguuuuuacuggacuucucgguagauggcuauauaagacgagcuauugauugcggauuuaaugauuuaucacaacuacauuguaguuacgaaucauucgauguugagagugguguuuauagugucucuuccuucgaagcaaaacccuccggauccguaguugaacaagcugaagguguugaaugugacuuuucacccuuauuaucuggcacaccaccccaaguauauaauuuuaaacguuuagucuuuacaaauuguaacuauaauuugacuaaauuacuaucacuuuuuagcguaaacgauuucacauguucacaaaucucacccgcagccauagcaucuaacuguuacucaucucuaauucuugauuacuuuucauauccuuuguccaugaaauccgaccucucuguaaguucagcaggaccaauuucucaauuuaauuauaaacaaucuuuuagcaauccaacgugcuuaauauuagcaacaguaccacacaaucuaacgacaauaacaaaaccccugaaauacucauauaucaacaaaugcagcagauuacucagugaugauagaacagaaguaccccaguuaguuaacgccaaucaauauagucccugcguaucuaccguuccuucaacuguaugggaagauggagauuauuacagaaaacaacuuucgccauuggaggguggaggaugguuaguagcauccggaucaacuguagcuaugacagaacaacuacaaaugggcuuuggcauaacaguucaguauggaacagacacaaacucaguaugcccaaaacuagaauuugcaaacgauacaaagauagcaucucaauuaggaaauugcguagaauauucccuauauggcguaagcggacgcggaguauuucaaaauuguaccgcaguaggaguaagacagcaacgauucgucuacgaugcauaucagaauuuagucggcuauuacucagaugacggcaacuauuacugcuuaagagcaugugugucaguaccaguuucugucauauacgauaaagaaaccaaaacacacgcuacacuauucggcucagucgcaugcgaacauauauccucuacaaugagucaauacucacgauccacacgcaguauguuaaagcgaagagacucuacuuacgggccacuccaaacaccaguuggauguguucuaggguuagucaauagcaguuuauucguugaagacuguaaacuaccauuaggucaaucuuuaugcgcauuacccgacacccccucaacacuuacaccuagaucugugaggucuguaccaggugaaaugagacuagccucuauugccuuuaaucacccuauacaaguagaccaauuaaauucuuccuauuucaaacuauccauaccaacaaauuucucauucgguguaacacaagaauauauacagaccacgauccaaaaaguaacggucgauuguaagcaauauguaugcaauggauuucaaaaaugugaacaacucuuacgcgaauauggacaauuuuguuccaaaauaaaccaagcccuucauggagcuaaccugagacaggaugauucuguaagaaauuuauuugcuuccguaaaaucuucacaguccucaccaaucauuccuggauuugguggcgauuucaaccucacucuucuggaaccaguuuccauauccaccggcucgaggucagcucgaucagcuauugaagauuuauuguuugauaaaguuacaauagcugauccagguuacaugcaaggguacgaugauuguaugcaacaagggccugccucugcccgagauuuaauuugugcucaauacguugcagguuauaaaguauuaccaccacucauggaugucaauauggaagcugcauacacaucuucacucuuaggaucaauagcaggcguggguuggaccgcgggacuuucaucuuucgcagcuauaccuuuugcacaauccauauucuaucgccuuaacggcguaggaauuacucaacaaguuuuaucugaaaaucaaaaauuaauagcaaauaaauucaaucaggcuuuaggugcuaugcaaacuggauuuacaacaacaaacgaagcauuucgcaaagugcaagacgcggucaacaacaaugcccaagcccuaagcaaacuagcaucagaacuuaguaauaccuuuggagcaauuucagccaguauaggugauauuauucaacgacucgacguauuagaacaagaugcccaaaucgaucgcuuaauuaacgggagauuaacaacccuaaaugcauuugucgcucaacaauuaguaagauccgaaucagcagcucuaagcgcacaauuagcuaaggacaaaguaaacgaauguguaaaagcacaaucaaagagaucugguuucuguggacaaggaacccauauuguaucguuuguaguaaacgcaccuaauggacucuacuuuaugcacgucgguuauuaucccucaaaccauauagaagucgucucugcauauggauuaugcgaugcagcuaauccuacaaauuguauugcaccagucaacggauacuuuauaaaaacuaauaacacccgcaucguagaugaauggucauacacugguucuucauucuaugcuccagaaccaauaaccucccuaaacacgaaauacgucgcuccucaagugacauaucaaaauauuucaacaaaccuaccuccuccacuacuugguaauucaacuggcauugauuuccaagacgaacuggaugaauuuuucaaaaauguaucaaccuccauaccaaacuuugguucauuaacucaaauaaacacuacauuguuagacuuaacuuaugaaaugcuaucucuacaacaaguuguaaaagccuuaaacgaaucauacauugaucuuaaagaauuagguaauuacacuuacuacaauaaauggccuugguauauuugguuaggauuuauagcaggauuaguagcucuagcuuuguguguuuucuucauacuuuguugcacugggugcggaaccaacugcaugggaaaacuuaaauguaaucguuguugcgaucgcuacgaagaauaugaccuagaaccccacaaaguacacguacacuaa

SEQ ID NO: 1095 - RNA, 4062 nt, Artificial Sequence
  derived and/or modified CDS sequence (opt6) from MERS-CoV__AKN11074__S
augauccauagcguauuucucuuaauguuucucuuaacaccaacugaaucauacguggauguaggaccugacagcguaaaaucagccugcauugaaguagacauacagcaaacguucuuugacaaaacuuggcccagaccaauagacguaaguaaagcugacggaauuaucuauccccaaggacguacauauuccaacauaacuauaaccuaucagggucuguuuccauaucaaggagaucauggcgacauguacgucuacucagcaggucacgcuaccggcacaaccccucaaaaauuguuuguggccaauuauagucaagacguaaaacaauuugcaaauggauuuguaguacgaauuggagcagcugcuaauucaacuggaacaguaauaauaucaccuuccacauccgcuacaauuagaaaaaucuauccugcuuuuaugcuaggaucgucagucggcaacuucucugacgggaaaaugggacguuucuuuaaccacacucucguccuccuaccugacgguugcggaacauuacuuagagcuuuuuauuguauucucgaaccgagaucugggaaucauuguccagcagguaauucuuauacuagcuuugcuacauaucacacgccagccacggacugcuccgauggaaauuauaaucgaaaugcuucccuuaacaguuuuaaagaauacuuuaaucucagaaacuguacauuuauguauacuuacaauauuaccgaagaugaaauauuagaaugguucggaauuacacaaacagcacaaggaguucaccuauuuaguucuagauaugucgauuuauacggcggaaauauguuucaauucgcaacuuuaccagucuaugauaccauuaaauacuacuccauaauaccucacuccauucgcucaauacaauccgacagaaaagcaugggcagcuuuuuacguauauaaacuucagccacuaaccuuccuuuuggauuuuucaguagauggcuauauccggagggcaauugacuguggcuucaacgauuuaucccaauuacauugcucuuaugaaucauucgauguagaauccggaguauauucagucagcucauuugaagcaaaaccaucuggcucaguaguggaacaagcagaaggagucgaaugcgauuucucaccacuacuaucagguacuccuccccaaguguauaauuucaaacgauuaguauuuacaaauugcaacuauaaucuaaccaaacuacuaucauuauuuagcguaaacgacuuuacguguucucaaauaaguccagcugcuauagcuucuaacugcuacagcucuuuaauucuagauuacuucagcuacccucuaucaaugaaguccgacuuaucaguaucuuccgcagguccuaucagccaauucaauuauaaacaguccuucuccaauccaaccugccuaauacuggcaacaguaccccauaauuuaacaacaauaacaaaaccgcuuaaauauucuuauauuaacaaaugcuccagauuguuaucagaugaccgcacagaaguaccacagcuaguuaaugcaaaccaauacucacccuguguaaguaccguaccauccacuguuugggaagacggagacuauuaccguaaacaacugucaccuuuggaaggaggcggauggcuaguagcaucagguucaacaguagcgaugacagaacaacuucaaaugggauuugguauaacaguacaauacgguacugauaccaacucuguaugcccaaaauuagaguucgcaaaugauacaaaaauagcuagucaauuaggaaauugcguagaauacucucuuuauggcguaucgggcagaggaguauuccaaaauuguacagcaguuggagucaggcagcaacacuuugucuaugaugccuaucaaaaccuuguagguuauuauucugaugacgggaacuauuauugccuaagggccugugucucgguacccgucagugucauauaugauaaagaaacaaaaacacacgcuacucucuuuggaagcgucgcaugcgaacauauaucauccacaaugucacaauauucacguucuacaaggucaaugcuaaaaagacgugacagcacuuauggaccucuacaaacuccagucggauguguacucggcuuaguaaauuccucucuuuuuguggaagacugcaagcuaccucuaggccaaucauuaugugcccucccagauacacccucuacacuaacgccaagaucaguuagauccguacccggagaaaugcgucuagcuuccauagcauuuaaucauccaauccagguagaucaacuuaauaguucauacuuuaagcuaagcauucccacaaacuuuaguuuuggugucacucaagaauacauacaaacaacaauccaaaaaguaaccguagacuguaaacaauacguuugcaauggauuccaaaaaugugaacaauuacuuagagaauacggccaauuuuguuccaaaauaaaucaggcccuacacggagcaaacuuacgacaagacgauucuguaagaaaccuauucgcuucaguuaaaagcagucaaucuucuccaaucauuccaggguuugggggugauuucaacuugacacuauuagaaccaguaucaaucucuacugguagucgcucugcaagaucugccauugaagaccuacuauuugacaaaguaacaauagcagaccccggauauaugcaaggcuaugaugacugcaugcaacaaggaccggccucagcucgugacuuaauaugugcacaauacguagcaggauauaaaguacuuccacccuuaauggaugucaacauggaagcagcuuauacauccagucuuuuagguuccaucgcaggaguugguuggacagccggcuugucaucauuugcagcaauuccuuucgcacaaucuauauucuaucgauuaaaugguguaggaauaacacaacagguauuaagugaaaaccaaaaacuuaucgcaaauaaauucaaccaagcacucggagccaugcaaaccggauucacgacuacaaaugaagcauuccgaaaaguccaagaugccguaaauaacaacgcacaagcauuaagcaaacuugcuuccgaacucucuaauaccuucggagcuauuucugcuuccauaggugacauaauccagagacuagacguacuagaacaagaugcucaaaucgauagauuaauaaacggacgucuuacaacauuaaacgccuuuguagcccaacagcuaguacguuccgaauccgcagcacugucagcucaacuagcaaaagacaaaguaaacgaaugcguaaaggcucaauccaaaagaagcggauuuuguggccaagguacacauaucguaucauucguuguaaaugcuccaaacggccuauacuuuaugcacguaggauacuaccccagcaaccauauagaagucguauccgcuuacgguuuaugugacgcugcaaacccaacaaauuguauagcuccaguuaauggcuauuucauaaaaacuaacaauacgcguaucguugacgaauggucauauacugguucgagcuucuacgcacccgaacccaucacuucauuaaauacaaaauauguagcaccucaagucacuuaccagaacaucucaacuaacuuaccgccgccuuuauugggcaauuccacuggcauugauuuucaagacgaacuagaugaauuuuucaaaaacguuucaacauccauaccaaauuuuggaucacuaacacaaauaaacacaaccuuacuugauuuaacuuaugaaauguuaucguuacaacaaguuguuaaagcucucaaugaaagcuacaucgaccuaaaagaauuaggaaacuauacguauuauaauaaauggccuugguacauuuggcucggcuucauagcuggccuaguagcuuuagcauuauguguauucuuuauucuauguuguacuggaugugggacaaauuguauggguaaacugaaaugcaaucgauguugcgaucgauacgaagaauacgauuuagaaccccacaaaguacauguacauuaa

SEQ ID NO: 1096 - RNA, 4062 nt, Artificial Sequence
  derived and/or modified CDS sequence (opt6) from MERS-CoV__AKN24803__S
augguacacucaguauuuuuacuuauguuccuauuaaccccuacugaaucauacgucgacguagggccagacucuguaaaaucagcuuguaucgaaguagauauucaacagacauucuucgauaagaccuggccgcgaccgauagauguuagcaaagccgacggcauaauuuauccucagggacguaccuauaguaacauuacaauaacauaccaaggacuguuucccuaucaaggagaccacggagauauguacguauauuccgcugggcacgccacaggcacaacaccccagaaacuauucgucgcuaacuauagucaggacgucaaacaauucgcaaacggcuuuguagucagaauuggagcagcagccaauucgacaggaacuguuauuaucagcccuucuacaucagcuacuauuaggaaaauauauccugcauucaugcuaggaagcucagucggaaacuuuucagaugguaaaaugggacgauuuuucaaucacacauuaguccuauuaccugauggauguggaacacuccugcgcgccuuuuauugcauauuagaaccacgaucgggaaaucauuguccugcuggaaauucuuacaccagcuuugcaacuuaccacacuccggcuacagacugcuccgacgguaauuauaacagaaaugcgucacuaaauagcuucaaagaauauuucaaccuaagaaauugcaccuuuauguauacuuauaauaucacagaagaugaaauucuugaaugguucgguauuacccaaacagcacaaggcguccaucucuucucuucuagauauguagaucuauacggaggaaacauguuucaauuugcuaccuuaccaguuuacgauacuauuaaauauuauucuauaauuccacauuccaucagauccauucaauccgaucggaaggccugggccgccuucuacgucuauaagcuacaaccauuaacauuucuauuagacuuuucuguugauggauauauaagacgcgcaauagauugugguuuuaacgaccuuucucaauuacauugcucauaugaaucauuugauguugaaucuggaguguauuccgugucuucuuucgaagcaaagcccagcggcucuguuguagaacaagcugaagguguugaaugcgacuucaguccuuuauuaagcggaacaccaccccaaguguacaauuucaaaaggcuaguuuuuacgaauuguaauuacaauuucacaaagcuauuaucacuuuucagcgucaaugacuuuacaugcucacaaaucucacccgcugcaauugcgucuaauuguuacuccucuuuaauacuagauuacuuuucauacccgcuuucaaugaaaucagaccuaucagugagcucagcaggaccaauaucccaauuuaacuauaaacaauccuucucaaauccaacgugccuaaucuuagcuacggucccacauaaucuaacuaccaucaccaaaccgcuaaaauacuccuauaucaauaaaugcucccgccucuuaucugaugacagaacugaaguuccccaauuaguaaacgcuaaucaauacaguccaugcgucucaaucguacccuccaccguuugggaagacggagacuauuaucguaaacaacuaucgccacuagaaggaggcggcugguuaguugcuucugguucuacuguugcuaugaccgaacaacuacagaugggcuuugguauaacaguacaguacggaacugauacuaauucagucucuccaaaauuagaauuugcaaacgauacuaaaauagccucacaacuuggaaauuguguugaauauucucuuuacgguguuuccgguagaggaguuuuucaaaauuguaccgcaguagguguccgucaacaacgauuugucuaugaugcuuaucaaaaucuuguggguuauuacucugacgacggaaacuauuauugucuuagagcaugcgucucuguuccaguaucuguuauauaugauaaagaaaccaaaacccaugcaacucuuuucggaucugucgcaugugaacauaucagcucuacuaugucacaauacucacgcagcacaagauccauguugaaacgaagagauuccaccuauggaccacuucaaacaccaguaggauguguucuuggguuagucaauucaucucuauuugucgaagacuguaaacuaccccuuggacaaucccuuugugcguuaccugauacaccaucaacacuaacaccaagaagugucagaagcguaccgggugaaaugagauuagcauccauagcauucaaccauccaauacaaguagaccaacuuaauuccagcuauuuuaaacuaucaaucccgacaaauuuuuccuucggaguaacccaagaauacauacaaaccacuauacaaaaggucacaguugauuguaagcaauacguauguaacgguuuccaaaaaugugaacaacuucugcgagaauacggacaauucuguagcaaaauaaaccaggcucuccauggcgccaaccuaagacaagacgacuccguucgaaaucuauuugcaucugucaaauccucacaaucuucuccuauaauuccaggauuugggggagauuuuaauuuaacauuacucgaacccguuucgauaaguacuggcucgcguucagcacgauccgccauugaagaucuuuuguuugacaaaguaacaauagcugauccaggcuacaugcaagguuaugacgacugcaugcaacaaggaccggccucugcuagagaucuaaucugcgcacaauacguugcuggcuauaaaguacugccaccacuaauggacgucaauauggaagccgcuuauacauccucauuauuaggauccaucgccggaguaggauggacagcaggacuuucauccuuugccgccauaccuuuugcucaaucaauuuucuauagacuuaauggugucgguauuacacaacaaguucuuuccgaaaaccaaaaacuuauugccaacaaauucaaucaagcauuaggcgccaugcaaaccggauuuacaacaacaaacgaagcauuucguaaaguucaagaugcaguuaauaauaacgcacaagcacuuucaaaauuagccucagaauuaucaaauacuuuuggugcaauuagcgcaucaauaggagacauaauacaacgauuagacguccuugaacaagacgcacaaauugaccgauuaauaaacggaagauuaacaacacuaaaugcauucguagcccaacaauuaguaagaagcgaaucugcagcacuuagugcacaauuagcaaaagauaaaguaaaugaauguguaaaagcucaauccaaacguucggguuuuugugggcaaggaacccauauaguaucauucguugucaacgcucccaacgguuuauauuuuaugcacguuggauauuauccaucuaaccauaucgaaguuguuucugcauauggacuuugcgacgcugccaacccuacuaacugcauagcaccaguaaauggauauuucauaaagacaaacaacacacgcauuguagaugaauggaguuacacuggaaguaguuuuuaugcccccgaaccaauaacaucuuuaaacacaaaauacguugcaccccaaguaacauaucaaaacauaucuacaaaucuuccaccucccuuacuuggaaacucuacugguauagacuuccaggacgaauuagacgaguucuuuaaaaacgucucuaccagcaucccaaacuuugguagccuaacucaaauaaauacaacacuuuuagauuuaacauaugaaauguuaucccuucaacaaguagucaaagcacuaaaugaaucauauaucgaucuaaaagaauuaggcaauuauaccuacuauaacaaauggccaugguauaucuggcucggauuuauagccggacuuguagcacucgcucucugcguuuucuuuauauuguguugcacaggauguggaacuaauugcauggguaaacuaaaaugcaauagaugcugcgauagguacgaagaauaugaucuagaaccacauaagguucacguccacuaa

SEQ ID NO: 1097 - RNA, 4062 nt, Artificial Sequence
  derived and/or modified CDS sequence (opt6) from MERS-CoV__AKN24812__S
augauacauucaguuuuucuccuaauguuccuacuaaccccaacagaaucuuauguugauguaggaccugacucuguuaaaucugcuugcauagaaguugacauacaacaaacauucuuugacaaaacuuggccgagaccuauugaugucagcaaagcagacgguauuauuuauccacaaggcagaaccuauaguaauauuaccauaacauaccaaggauuauuuccauaucaaggagaccacggugauauguacguauauucugccggucaugccacuggcacaacaccucaaaaauuauucguugccaauuauucacaagacguaaaacaauucgcaaauggauucgucgucagaauaggagcugcagcaaacucaacagguacaguaauaauaaguccuaguacuucagcuacaauaagaaaaaucuauccagccuuuauguuagggucaucaguaggaaauuucuccgacggaaaaaugggacgcuucuuuaaccacacauuaguccuccuuccagacggaugcggaacccuucuucgugcauuuuauuguauacuugaaccacgaucuggaaaucacuguccugccggaaauucuuacacuucuuuugccaccuaucacacaccagcaacggauuguuccgacggcaacuacaaucgaaaugcuaguuuaaauucauucaaagaauacuuuaauuuaagaaauugcacauuuauguacaccuacaacaucacugaagaugaaauucuugagugguuugguaucacacaaacagcacaagguguccaccuauucucgucucguuacguagaccuuuaugguggaaauauguuucaauucgcaacuuugccaguauacgauacaaucaaauacuauuccauuauaccucacagcauacguuccauucaaucagauaggaaagcaugggcagcauucugcguuuacaaacuucaaccccucacauuccuuuuagauuucuccguagacggguauauaagacgagcuauagacugugguuucaacgaucuuucacaacuccauuguucauacgaaaguuucgaugucgaaucgggaguauacuccguaucaucauuugaagcaaaacccucuggaucgguaguugagcaagcggaaggaguagaaugcgauuucucaccacuacuaucuggcaccccuccucaaguauacaauuucaaacgucugguauucacuaacugcaauuauaauuuuaccaaauuacuuucucuguuuagcguaaacgacuucacauguagucagauuucgccagcagcaauugcuucaaauugcuauaguagccuuauacuagacuauuucucauacccccuaaguaugaaaucugacuuauccguaagcucagcaggaccaauaucacaauucaauuacaaacaauccuuuuccaacccaacauguuugauccucgcaacaguuccucacaaccuaacgacaauuaccaaaccucuuaaauauucuuacauuaacaaauguagucgauugcuuucugacgaucgaacagaagugccccagcuagucaacgcaaaucaauacucgcccugugucucuauuguuccaucaaccguaugggaagauggugauuauuauagaaaacaacuuucucccuuagaaggugguggcugguuaguugcaucaggcucgacaguagcaaugacggaacaauuacaaaugggauucgguauaacaguccaauauggaacagauacaaacucugucuguccuaaacuagaauuugcaaaugauacuaaaaucgcaucucagcucgguaauugugucgaauauucucuauaugguguauccggaagaggagucuuccaaaacuguacugccguuggcguaagacagcaaagauuugucuacgaugcauaucaaaacuuaguuggauacuauagcgacgaugguaauuauuauugucucagagcaugcguauccguaccugucucagucaucuacgauaaagaaacuaaaacucaugcuacacuguuuggaucugucgcgugugagcacaucucaucaacuaugucccaguauuccagaucaacacgaucuaugcuuaaaaggagagauuccacuuacggaccccuccaaaccccaguaggauguguccuaggcuuaguaaacucaucacucuuuguggaagacuguaaacuaccacucgggcaaagccuaugugcacuuccagauacucccucuacucuuacaccuuguucuguucgaaguguaccaggcgaaaugcgccuagcuucaauagcuuuuaaccaccccauacaaguugaucaauuaaauucuagcuauuuuaaauuaucaauaccaaccaauuuuucauuuggcguuacacaagaauauauacaaacuacaauccaaaaaguuaccguugacuguaaacaauauguuugcaacggcuuucaaaagugugaacaacugcugagagaauacggccaauuuuguucaaaaauaaaucaggcuuuacauggcgcaaauuugagacaagaugauucaguuagaaaccuguuugcuucaguuaaaucaucucaaaguuccccaaucauucccggauucgguggugauuuuaaucucacacuauuagaaccagugucaauaucuacaggaucaagaucagcuagaucugcaauugaagaccuucuauuugauaaaguuacaauagcagacccuggcuacaugcaaggauacgacgacuguaugcaacaagguccagcgagugcccgugaucucauaugugcacaauacguugcaggcuauaaaguccuacccccucuaauggacguuaauauggaagcagcguauacaucaucauuauuagguucaaucgcugguguuggauggacugcaggacuuucuaguuucgccgccaucccauuugcacaaucuauauucuacagacuaaacgguguugguauaacucaacaaguauuaucagaaaaucaaaaauuaauagcuaacaaauucaaccaagcacuuggagccaugcaaaccgguuuuacaacaacaaacgaagcauucagaaaaguccaagaugcuguaaacaacaacgcacaagcauuaagcaaacuagcaucugaacucagcaauaccuuuggagcaauaagugcaucaaucggagacaucauucaacgcuuagauguucucgaacaagaugcacaaauagacaggcucauaaacggaagacuaaccacacucaaugcauucguagcacaacaauuaguucgauccgagucugcugcucuuucugcacaacuagcuaaagacaaaguaaacgaaugcgugaaggcacaaaguaaacguucagguuuuugcggacaggguacacacauaguaucauucguaguaaacgcgccuaacggucuuuacuucaugcauguuggauacuauccuucuaaccauauugaagucguauccgcuuauggucucugugaugcugcaaaucccacaaauugcauagcaccaguuaacggcuauuuuaucaaaacaaauaacacucgcauuguagaugaauggucauauaccggaucuucuuucuaugccccggaaccuauaacgucuuuaaacacuaaauauguugccccacaaguaaccuaucaaaauauaucaaccaaccuuccaccaccccuguuaggaaacucuacaggaauugauuuucaagacgaacuagacgaauuuuucaaaaacguauccacaaguauaccuaauuuugguagucuuacacaaauuaauacaacuuuauuagaccuaacauaugaaauguuaucucuacaacagguaguaaaagcccucaacgaaucuuacauagauuuaaaagaauuagguaauuauacauacuacaauaaauggccaugguauaucugguuaggguuuauugcuggacuuguagcucuagcacucuguguauucuucauccuaugcugcacaggcuguggaacaaacugcaugggcaaauuaaaaaguaauagauguugugaccgauaugaagaauaugaccuagaaccacauaaaguucacguucauuaa

SEQ ID NO: 1098 - RNA, 4062 nt, Artificial Sequence
  derived and/or modified CDS sequence (opt6) from MERS-CoV__AKN24830__S
augauacacucagucuuucuacuaauguuccuccuaacacccacagaaucuuacguugauguuggaccagauucaguuaaaucugcauguauugaaguugauauucaacaaacauucuuugauaaaacuuggcccagacccauagacguaucaaaagcagauggcauaauauauccacaaggucgaaccuauagcaacaucacaauaacauaccaaggcuuauuucccuaucaaggugaucacggagacauguacguauacuccgcuggccaugccacaggcacaacaccacaaaaacucuucguugcuaauuauucacaagacguaaagcaauucgcaaauggauuuguuguccgcauuggagcugccgccaacucaacaggaaccgugaucauuucaccauccacauccgcaaccauccgcaaaauuuauccugcauucaugcuaggaucaucaguagguaauuuuucagauggaaaaaugggacgauucuuuaaccauacucuaguccuacuaccugauggaugcggcacucuacuuagggcauuuuauuguauuuuagaaccucgaucuggcaaucauugucccgcaggaaacaguuauacaaguuuugcaacuuaucauacacccgccacggauuguucugauggcaacuauaauagaaaugccucucucaauucuuuuaaagaauauuuuaauuuacgaaacuguacauuuauguauacguauaauauaacagaagacgaaauauuagaaugguucggaaucacccaaacugcgcaagguguccaccuauucucaucacgauacguagaucucuacggaggaaacauguuccaauuugcaacccuacccgucuaugauacaauaaaguauuacuccauaauaccucauucaauaagauccauacaaagugaccgaaaagcaugggccgcuuuuuacgucuauaagcuacaaccauuaacauuucuacucgacuuuucaguugauggauauauacgacgcgcaauagauugugguuucaaugauuugucucaacuccauugcucauacgagagcuucgacguagaaucaggaguauauucaguuucgaguuuugaagcaaaaccaucaggaagugucguagaacaagcugaaggaguugaaugcgauuuuucaccacuucuaagcggaacaccaccacaaguauacaacuuuaaacggcucguguucaccaauuguaacuacaacuuuacaaaauuauuaagucuauuuucagugaacgacuucacauguucgcaaauaagucccgcagccauagcauccaauuguuauuccucucucauacucgauuacuuuucauauccccucucaaugaaaucugaucuaagcguauccagugccgguccaauaucacaauuuaauuauaaacaaucuuuuaguaauccaacuugucuaauacuugcaacugucccacauaaccugacaaccauaaccaaaccacuaaaauauucguauaucaauaaauguucucgacuccucucugacgaccguacagaaguaccucaacuuguuaaugccaaccaauauucaccuuguguuucaauaguaccuuccacaguaugggaagauggcgauuacuaucgaaaacaauuaucaccucuagaaggcgguggauggcucgucgccucagggccaacuguagcaaugacagaacaacuucaaauggguuucgguauaacuguucaauauggaacagacaccaacuccguaugcccaaaacuugaauuugccaaugauacaaaaaucgccucacaauuaggcaacugcguagaauauucauuauacggaguauccggaagagguguauuccaaaacugcacugcuguugguguccgacaacaacguuuuguauaugacgcauaccaaaauuuaguaggauacuauucagaugauggaaauuacuauuguuuaagagcaugcgucuccgucccugucagcguuaucuacgauaaggaaacaaaaacucacgcuacucuuuuuggaucagucgccugcgaacauaucucaucaacaaugucacaauauucacgaucaacccggucuaugcuaaaacgacgagauucaacauacggcccucuacaaacgcccguaggcugcguccuuggacugguaaauucuucucuauuuguugaagacuguaaacuaccccuuggccaaaguuuaugcgccuuaccagauacaccuagcacacuaacuccacgaucaguuagaucuguaccaggagaaaugaggcuugccagcauagcguuuaaucauccuauucaaguugaccaacuaaauuccuccuacuucaagcuaucaauacccacaaauuuuucuuuuggugucacccaagaauauauacaaacaacuauucaaaaagucaccguugacuguaaacaauauguuugcaacgguuuccaaaagugcgaacaauuacuaagagaauauggacaauucugcagcaaaauaaaccaagcguuacauggcgcaaaucuacggcaagacgauagcguacgaaauuuauuugcuagcguaaaaaguucccaauccucaccuauaauucccgguuucggaggagauuuuaaccuaacauuacuagaaccaguauccauaucaacaggaucaagaagugcuagaucagcaauugaagaccuacuauucgacaaaguuacaaucgcagaccccgguuauaugcaaggguacgaugauugcaugcaacaagguccugcuucagcccgagaccuuauuugugcccaauauguggcagguuauaaaguacuaccgccccuaauggauguuaacauggaagcggcauacaccuccuccuuauuaggaucaauugcugguguuggauggaccgcaggacuuucauccuuugcggcaauacccuuugcccaaucuauauucuaccgccuaaauggaguugguauuacacaacaaguccuuagcgaaaaccaaaaacugauagcuaauaaauuuaaucaagcacuuggagcuaugcaaacaggcuuuaccaccacuaacgaagcguuucgaaaaguacaagaugccguaaacaauaacgcucaagcucuaucaaaauuagcaagugaacucucaaauaccuucggagcaauuucagcuucgauaggagauauaauacaacgacuagauguacuagaacaggaugcucaaaucgaucgacugauaaauggaagacuuacaacauuaaaugccuuuguugcucaacagcuaguucgaagcgaaucugcugccuugucugcccaacucgcgaaagauaaagucaaugaguguguuaaagcacaaucuaaaagaucagguuucuguggccaaggaacucauauaguaucuuucgucguaaaugccccuaacgguuuauauuuuaugcauguaggauacuauccaagcaaucauaucgaaguaguuucugcguacggccuaugcgaugcagcaaauccgacaaauuguaucgcuccuguaaacggguacuucauuaaaaccaauaauacuaggauagucgaugaauggucuuacacuggcucaucauuuuaugcccccgaaccaaucacuuccuuaaauacaaaauauguagcaccacaaguaacuuaccaaaacauaucaaccaauuuaccaccaccucuauuagguaauucaacuggcauugauuuccaagacgaacuagaugaauuuuucaaaaacguauccaccucuauucccaacuucggaucuuuaacacaaauaaacacuacccuauuagaccucaccuacgaaaugcuuucauuacaacaaguagucaaagcccuaaacgaaagcuauauagaccuuaaagaauuaggaaauuauaccuacuauaauaaauggccaugguauauauggcuuggguucauugcugguuuaguagcccucgcacuuugcguauuuuucauauuauguuguacaggauguggaacuaauuguaugggcaaauuaaaaugcaauagaugcugugauagauacgaagaauacgaccuggaaccacacaaaguucauguacauuaa

SEQ ID NO: 1099 - RNA, 4062 nt, Artificial Sequence
  derived and/or modified CDS sequence (opt6) from MERS-CoV__ALB08257__S
augauacauucaguauuuuuauuaauguuucuccuaacaccaaccgaguccuaugucgauguagguccagacaguguaaagucggcaugcaucgaggucgauauacaacaaacauuuuucgacaaaacauggccacgacccauagauguaucaaaagcugaugggauaaucuauccacaaggccguacauauucaaacauaacaauuacuuaccaaggccuuuucccauaucaaggagaucauggugauauguauguauacucagcugggcaugccacaggcacgacuccccaaaaauuauucguugcaaacuacucacaagaugucaaacaauucgccaacggauuugucguaagaauaggcgcagccgccaacagcaccggaacagucauaauaucccccuccacaagugcuacgauaagaaaaauauauccagcauucauguuagguucaucaguagguaauuucucugauggaaaaaugggcagguuuuucaaccacacuuuaguuuuacuaccagauggauguggaacgcuauugagagcuuucuauuguauucuagaaccacgcucagggaaucacuguccugcaggaaauuccuauacaucguuugcaaccuaucauaccccagcaaccgauuguuccgacggaaauuauaaucguaaugccuccuuaaauaguuucaaagaauauuuuaaucuaaggaacuguacauuuauguauacuuauaauauaacagaagaugaaauacuagaaugguuuggaauaacacaaacagcacaaggaguccaucuuuucuccagccgcuacguagauuuauacggaggaaauauguuccaauucgccacacuaccagucuacgauaccaucaaauauuacucaauaauaccucacucaauaagaucaauucaauccgauaggaaagcaugggccgcauucuacguauacaaauuacagccauuaaccuuccuucuugauuucucaguagauggauacaucagaagggcaauugauugcggcuuuaacgauuuaucacaacuacauuguucuuacgaaaguuucgacguugaauccggcguguauuccguaucaucuuuugaagcuaagccaucagguucugucguagaacaagccgagggaguagaaugugacuucaguccauuacuuucagguacacccccacaaguuuacaauuucaaaagauuaguauuuaccaacugcaauuauaaccucacaaaacuacucuccuuguuuucaguuaaugacuucacauguucacaaauuucaccagcagccauugcauccaauugcuauuccucacuuauauuagacuacuucucauacccucucaguaugaaaucugaccuuucaguaucuuccgcaggaccaauaucccaauucaacuauaaacaauccuuuucgaauccaaccugccuaauucuagcaacuguuccucacaaccucacuaccauuacuaaaccucuaaaauacucauacauuaacaaaugcucaagacuucuaucagacgacagaacagaaguaccacaauuagucaacgcaaaccaauauuccccgugcguaucgauugucccaucuacgguuugggaagacggugacuacuauagaaaacaacuuucaccucuagaaggaggagguuggcuaguugcaagcggcuccacuguagccaugacagaacaacuucagaugggauuugguauuacgguucaauacggaacagacacaaauuccguuugccccaaacuagaguucgccaaugacacaaaaauagcaagucaauuaggaaacuguguagaauauucauuguacggaguaucaggcagaggagucuuucaaaauugcacagcuguagguguaagacaacaacgauuugucuaugacgcuuaccagaaucuuguuggauauuacucugacgauggcaacuacuauugucucagagcauguguuuccguaccuguuagcgucauauaugauaaagaaacaaaaacccacgcuacacuauuuggaucaguagcaugcgaacacauuuccucaacaaugucucaauacucacgcucuacacguucuauguuaaaaagaagagauucaaccuacggaccuuuacaaacucccguaggauguguccuaggccuaguaaauaguucauuauuuguagaagauugcaaauuaccacuaggacaaucucuaugcgcucuaccggacacgccaagcacgcuaacuccacgaaguguaaggucaguacccggagaaaugcgacuagcaagcauugcguuuaaucacccaauccaagucgaccaauuaaacaguuccuacuuuaaguuaucaauccccacaaauuuuucauucgguguaacucaagaauacauacaaacaacaauacaaaaagucacaguugacuguaaacaauauguauguaauggauuccagaagugcgaacaauuauugagggaauauggacaguuuuguucuaaaauaaaucaagcauuacacggcgccaauuuacgacaagaugacagcguucgaaaccuuuuugcuucggucaaaucuucucaaucuucaccaauaauuccgggauucggaggagacuuuaaccuuacacugcucgaaccaguaucuauaucuaccgggucccgaucagcuagauccgcuauagaagaccuacuuuuugacaaaguaacaauagcagauccagguuauaugcagggauaugaugacugcaugcaacaaggucccgcuucugcucgagacuuaauaugugcacaauacgucgcaggauauaaaguccucccuccacucauggauguaaacauggaagcugcauauacaucaucucuauuagguuccaucgccgguguagguuggacugcaggcuuaucaucuuuugcagcuauuccauuugcacaauccaucuuuuaccgacuaaauggcguagguauuacacaacaaguucucuccgaaaaucaaaaacuuauugcuaacaaauucaaucaagcauuaggugccaugcaaaccgguuuuacuaccaccaacgaagcauuccgaaaaguucaagaugcuguuaacaauaacgcgcaagcucucuccaaacuagcuucagaauuaucaaauacauuuggcgcgauaucagcaucaaucggcgacaucauucguagacuugacgucuuagaacaggaugcucaaauagacagauuaaucaacggacgucuaacaaccuuaaaugccuucguagcucaacagcuaguacgaucagaauccgcagcuuuauccgcacaacuagcuaaagacaaagucaaugaauguguuaaagcacaaaguaaaagaucagguuuuuguggacaagguacucacauaguaucauuuguaguaaacgccccaaauggauuauauuuuaugcauguaggauacuaccccuccaaucauauagaaguaguaagcgcauauggacuaugcgaugcagcaaauccaacuaauuguauagcacccguuaacggguacuucaucaaaacaaauaauacccgcauuguagacgagugguccuacacuggaucgucauucuacgcacccgaaccaauaacuucauugaauacaaaauauguagcgccucaaguaacauaccaaaacauaucuaccaacuuaccacccccuuuacuagguaacuccacuggcauugacuuccaagaugaacuagaugaauuuuucaaaaauguaucuacaucaauaccuaacuucggaucacugacucaaaucaacacaacacuuuuagaucuaacuuaugaaauguuaagucuacaacaaguaguuaaagcauuaaaugaaucauauaucgaucuuaaagagcuaggaaauuauacuuauuauaacaaauggccaugguacauaugguuaggcuucauugcaggucuugucgcacuugcuuuauguguauucuucauuuuauguugcacaggauguggaaccaauugcaugggaaaacuaaaauguaacagauguugugaucguuacgaggaauacgaucuugaaccacauaaaguacacguacauuaa

SEQ ID NO: 1100 - RNA, 4062 nt, Artificial Sequence
  derived and/or modified CDS sequence (opt6) from MERS-CoV__ALB08311__S
augauccacucaguuuucuuacuaauguuccuuuuaacaccuacugaaucauacguagacguaggcccagauucuguuaaaagcgcauguaucgaaguagauauucaacaaacauucuuugacaaaacauggccacguccaauagaugucucaaaagcagauggaauaauauauccccaaggacguacuuauucaaacaucacuauaacauaccaagguuuauucccauaccaaggcgaucauggugauauguacguauacucugcgggauacgcgacuggcacaacaccacaaaaacuauuugucgccaacuacucacaagauguaaaacaauucgcuaauggcuuuguuguacguauuggagcagcagcaaauucaacaggaacaguaaucauuuccccuuccacaagcgcuacaauaaggaaaauauaccccgcauucaugcuagguagcucugucggcaacuuuucagacggcaaaaugggccguuucuuuaaucacacccucguacuacucccagacggcugcggaacacucuugcgcgcauuuuauuguauacuagaacccagaucugguaaucauuguccagcagguaacucguacacuucauuugccacauaccacacuccugcaacagacuguagcgauggaaauuauaaucgaaacgcaucauuaaacucauuuaaagaauacuucaaucuccgaaacuguacuuuuauguauaccuauaauaucacagaagacgaaauacuugaaugguuuggaauuacacaaacagcccagggaguccacuuauuuuccaguagauaugucgacuuauauggaggaaacauguuucaauucgcaacauuacccgucuacgauacuaucaaguacuauaguauuauuccccacucaauaagaaguauucaaagugacagaaaagccugggcugccuuuuauguuuauaaauuacaaccuuugacauuucuucuagauuucucgguagauggauacaucagacgagcuaucgauugugguuuuaaugaucuaucacaauuacacugcucguaugaaucauuugauguugaaucagggguauauucaguaucaucuuuugaagccaaaccuaguggaucgguugucgagcaagcggaagguguugaaugcgacuuuucuccauuacuuucugguacacccccacaaguauauaacuuuaagagacuuguauuuacaaauugcaacuauaacuuaacaaaauuacuuucucuguuuuccguaaaugauuucaccuguucucaaauaucaccagccgccauagcaucaaauugcuauucuucucuuauucuagacuauuuuucauacccuuuauccaugaaauccgaccuuucuguaucaucugcgggaccuaucagccaauuuaauuacaaacaaucguuuucaaaccccacauguuuaauuuuagccacaguaccucauaaccucacaacaauaacaaaaccccucaaauauucauacauaaacaaaugcucacgacuucucagcgauggacgaacagaagucccacaacugguuaaugcuaaucaauauuccccaugcguaucaauuguaccaucaacuguuugggaagacggcgauuacuauagaaaacaacuuagcccauuagaaggaggagguugguugguugcauccggaucuaccgucgcaaugacagaacaauuacaaauggguuuuggaaucacaguacaauauggaacagacacaaauucuguauguccaaaacuagaauuugcuaaugauaccaaaauagcaucccaauuagguaauugcguagaauauucucuauacgguguaucagguaggggaguguuucaaaauuguacagcaguugguguuagacaacagcgauuuguuuaugacgccuaucaaaaucucgucgguuacuauagugaugaugguaauuauuacugcuuaagagcaugugucagcguuccuguaucugucauauacgacaaagaaacgaaaacacacgcaacccuauucggaaguguagcaugugaacauauuucaaguacuaugucucaauacucaagaaguacuagauccauguuaaaaagaagggacagcaccuacggcccucuccaaacgcccguaggaugcguauugggauuaguuaauuccuccuuauucguagaagauugcaaauuaccucuaggucaaagccuuugcgccuuaccagauaccccaaguaccuuaacuccacgaucaguacguucagucccaggugagaugcguuuagcaucuauugcguucaaucaucccauacaaguugaucaacuuaauaguagcuauuuuaaauuauccaucccaaccaauuuuagcuuuggcgugacacaggaauauauucaaacaacaauucaaaaagucacaguugauugcaaacaauacguauguaacgguuuucaaaaaugcgaacaauuacucagagaauacggacaauuuugcucaaaaauaaaucaagcccuacauggugcuaaccuuagacaagaugauagcguucgaaaucuauuugcauccguaaaaucuagccaaucaaguccgauaauucccggauuuggaggagauuucaaucuaacacucuuagaaccuguauccauaucuaccggaucacgaagcgcaaggucagcaauugaagaccucuuauucgauaaagugacaauagcagaccccgguuauaugcaaggauaugaugacugcaugcaacaaggaccagccucagcacgcgacuuaaucugugcucaauauguugccggauauaaaguacuuccuccauuaauggacguaaauauggaagccgcauauacauccucucuacuaggcucuauagcuggugucggauggaccgcagguuuauccuccuuugcagcaauucccuucgcacaauccaucuucuacagacugaauggagucggcauaacacaacaaguucuaucagaaaaccaaaaacuuauagcaaauaaauucaaccaagcccuuggagcaaugcagacaggauucaccacuacuaacgaagcauucagaaagguucaggacgcuguaaauaauaaugcgcaagcucuaucgaaauuagcaucugaacuuagcaacacauucggagcaauaucagcaagcauaggagauauaauacaaagguuagauguccuagaacaagaugcccagauagauagauuaaucaaugguagacuaacaacacucaaugcauucguugcacaacaauuaguacgcucugaaucagcugcacuaagcgcacaguuagcuaaagacaaaguuaacgaauguguuaaggcccaaaguaaaagaucaggauucugcggucaaggaacucauaucguuagcuuuguaguaaaugcucccaacgguuuauacuucaugcauguaggauauuacccaaguaaucacaucgaaguaguaucugccuacggauuaugugacgccgccaacccuacaaauugcaucgcucccguaaauggauauuucauaaaaaccaacaauacucggauaguagaugaauggucauauacagguuccagcuuuuaugcaccugaaccuauaacuucucugaauacuaaauauguugcaccacaaguaaccuaucaaaauaucucuacaaaccuuccaccaccuuuauuaggcaacucaacgggaauugauuuucaagaugaacuagaugaauuuuucaaaaacguauccaccuccauacccaauuuuggcucucuaacccaaauuaauacuacacuccuagacuuaacuuacgaaauguuaaguuuacaacaaguaguaaaagcccuuaaugaaucuuauaucgaucuaaaagaacuaggaaauuauacuuauuacaacaaguggccaugguauaucugguuaggauuuauugccggauuaguagcacuagcccuaugcgucuuuuucaucuuaugcuguaccgguugugguacaaauugcauggguaaacuaaaaugcaaucgaugcugcgacagguacgaagaauaugauuuagaaccacauaaaguacacguacacuga

SEQ ID NO: 1101 - RNA, 4062 nt, Artificial Sequence
  derived and/or modified CDS sequence (opt6) from MERS-CoV__ALB08322__S
augauucacucaguauucuuauuaauguuucuauuaacaccaacugaaucauacguagaugucgguccagacucugucaaauccgcuugcaucgaaguagauauacaacaaacauucuuugauaaaacauggccaagaccaauagacgucuccaaagccgacgguaucauuuacccccaaggacguacuuacuccaauauuaccauuacauaccaaggacuauuuccuuaucaaggagaccacggcgacauguacgucuauucugcuggauacgcuacagguacuacaccacaaaaacucuuuguugccaauuacucacaagaugucaaacaauucgccaauggcuucgucguucgaauaggugccgcugcuaacucaacuggaacuguaaucauuucuccuucaacuucagcaacaauaagaaaaaucuacccugcauucaugcucggaagcagcguggguaacuuuagcgauggaaaaaugggucgauucuuuaaucacacucuuguacuacuaccagaugguugcgguacacuauuaagagcauuuuacuguauacuagagccacgaaguggaaaccauuguccagcaggcaauucauauacaucguuugccaccuaucacacaccagcuacagacuguuccgauggaaauuacaaccgaaaugcuucacuaaauucauuuaaagaauauuucaaucuccgaaauuguacauucauguacacguauaauauaacugaagacgaaauacuagaaugguucggaauaacucagacagcacaaggaguucaucuauucucauccagauaugucgauuuauauggaggaaacauguuccaauuugcuacauuaccuguuuaugauaccauuaaauauuauuccauaauaccgcauucaauacgaucuauacaauccgaccgaaaagccugggccgcuuuuuacguauauaaacuccaaccauuaaccuuccuacucgacuuuucuguggacggauacaucagacgcgcaauagauugcggauuuaacgaccucucacaauuacacugcucuuacgaaucauuugacguugaaucaggcguauauuccguauccuccuucgaagccaaaccuagugguucugucguagaacaagcugaaggggucgaaugcgauuuuucuccccuacugucugguaccccuccucaaguuuacaauuuuaaaagacuuguauuuacaaacugcaauuauaaucuuacaaaacuacuuucacuauuuucuguaaaugacuucacaugcucacaaaucucaccagcugccauagcgagcaauugcuacuccucuuuaauccuugacuauuucucuuaccccuuaucuaugaaaucagaccuaucuguaucauccgcaggaccaauaagccaauuuaauuacaaacaaucauucaguaacccuacuuguuuaauacuugcuacaguaccacauaaccuaaccacuauuacaaaacccuuaaaauauuccuauauaaauaaauguucacgacuauuaagugaugguagaacagaaguaccucaauuaguaaaugcuaaucaauacucacccuguguuucgauaguaccauccacagugugggaagacggcgacuacuaucgaaaacaacuaucuccacuagaagguggaggauggcuaguagcauccggaaguacaguagcaaugacagaacaacuacaaaugggauuuggaauuacaguacaauauggaacugauacaaauucuguaugcccaaaauuagaauuugcaaaugacacaaaaauugcaucacaguuggguaauuguguugaauacucucucuauggaguauccggucgaggcguuuuccaaaauugcacugcaguaggaguacgccaacaaagauucguuuaugaugcauaucaaaauuugguaggcuacuacagcgaugacggaaacuacuauuguuuacgugcaugugucucaguaccuguguccguaauauacgacaaagaaacgaaaacacacgccacucuauucggaucuguagcaugcgaacauauaucuagcacuaugucccaguacuccagaucuacaagaaguaugcuaaaaaggcgggauucgacuuauggcccauuacaaacaccaguaggcugcgucuuagguuuaguaaacucuucacuauuuguagaagauuguaaauuacccuugggacaaucucucugcgcacuaccagauacaccaagcacacucacaccaagauccguacgcucuguuccaggagaaaugcgacuagcuucaauagcauuuaaucaucccauacaaguugaccaacuaaauucaucauacuuuaaacuaucaauacccacaaacuuuuccuucggaguaacacaagaauauauacaaacuacaauucaaaagguaacaguggauuguaagcaauaugugugcaacggcuuucaaaaaugugaacaacuccuaagagaguauggucaauuuugcaguaaaaucaaucaagcauuacauggcgcaaacuugcgacaggacgauucaguuagaaacuuauuugccucuguaaaaagcucccagucgucuccuauaauuccaggauuuggaggagacuucaaucugacacuacuugagcccguauccauaucaacugguucacgaucagcacguucggcuauugaggaccugcuauuugauaaaguaacuaucgcagaucccggauauaugcaagguuaugaugauuguaugcaacagggcccugcuuccgccagagaucuaaucugcgcccaauaugucgcaggauauaaagucuuaccgccauugauggauguaaacauggaagcagcauauacaucuucacuauuaggaagcauagcuggcguaggauggacagccgguuuaucaucauuugcggcaauaccauucgcucaauccauauuuuauagauugaacgguguaggaauuacacaacaaguacuuagcgaaaaccaaaaauuaaucgccaacaaauuuaaccaagcccuaggcgcaaugcaaacuggcuuuacuacaacaaacgaagcguuccgaaaaguacaagacgccguuaauaauaacgcucaagcucuuucaaaauuagcaucugaacuuucaaacaccuucggagcuauaucugcauccaucggggauauuauccaacgauuagauguucucgaacaagacgcacaaauugaccguuuaauaaacggcaggcuuaccaccuuaaaugcuuuuguagcccaacaauuagugagaucugaguccgcagcacuaagcgcccagcucgccaaagauaaaguuaaugaaugugucaaagcucaauccaaaagaagcggcuuuugcggucaaggcacacacauaguaucauuuguugucaaugccccuaacggccuauauuuuaugcauguugguuacuauccuuccaaucacauagaaguaguaucugcauacggauuaugcgacgcagcaaauccuacuaacugcaucgcuccagucaacggcuacuuuauuaaaacgaauaauacuagaaucguagaugaauggaguuauaccggaucauccuucuaugcaccggaaccuaucacaucacucaacacaaaauauguagcaccacaaguaacauaccaaaacaucaguacaaauuuacccccucccuuacuugguaauuccaccggcauugauuuccaagacgaauuagacgaauuuuucaaaaacguauccacgucaauuccuaauuuuggcagucuaacccaaauaaauacaacgcucuuagacuuaaccuacgagaugcuaucccugcaacaagucguaaaagcacuuaaugaaagcuacaucgauuuaaaagaguuaggcaauuauacauauuacaacaaauggccaugguauauauggcuggguuuuauagcaggacuuguugcucuagcuuuauguguuuucuucauccucuguuguacaggauguggcacaaauuguaugggcaaauuaaaauguaauagauguugugauagauaugaagaauacgaucucgaauuacauaagguacacguccauuaa

SEQ ID NO: 1102 - RNA, 4062 nt, Artificial Sequence
  derived and/or modified CDS sequence (opt6) from MERS-CoV__ALD51904__S
augauacacuccguauuucuuuuaauguuucuucuaaccccuacagaauccuacguugacguagguccagauucaguuaaaucugcaugcauugaaguugacauucaacaaacguucuucgacaaaaccuggcccagaccaauagacguaucaaaagcagauggaauaauauacccucaaggaagaacuuauuccaacauaaccaucaccuaccaaggauuauucccauaccaaggagaucacggcgacauguacguauauucugcgggucaugcaacuggcacaacaccccaaaaacuauuugucgcuaauuauucucaagauguuaaacaauuugcuaacggcuuugucguaagaauuggcgcagcugcuaacuccacaggaacaguaauuauaaguccuuccacaucagcaaccauaagaaaaauuuauccagcauuuaugcucgggucaucuguagguaacuuuucagauggaaaaaugggaagauucuuuaaccauacauugguccuuuuacccgauggguguggcacauuacuacgugccuuuuauuguauccuagaaccuagauccggcaaucauugcccagcuggcaauuccuauacuucauuugcuaccuaccacaccccugccaccgacuguuccgauggaaauuacaauagaaaugcuucauuaaacaguuuuaaagaauauuuuaaucuccguaauugcacauuuauguauacguauaauauaaccgaagaugaaauucuggaaugguuugguaucacucaaacagcacaagggguucauuuauucucuucaagauacguugaucuauacggaggaaacauguuucaauuugcaaccuuaccugucuaugauacuauuaaauauuauuccauaauaccacacucaauucgaaguauacaaucugaucgaaaggcuugggcagccuuuuauguauauaaacuacaaccucuuacuuuucuacucgacuuuagcguugaugguuauauccgcagagcaauugacuguggcuucaacgaucuaagucaacuacauuguucuuaugaaucauuugacguugaaucagguguauauucuguuucaucuuuugaggcaaaaccauccgguaguguuguagaacaagcagaaggcgucgagugugauuucucuccauuguuaucagguacaccuccucaaguauauaacuuuaaaagacugguauuuacuaacugcaauuauaauuuaacaaaacuacucucauuauucucaguaaaugauuuuacauguucucaaauaaguccugcggcaauugcuucaaacuguuauucaagucucauuuuagacuauuucucauaucccuuaucaaugaaaucugaccucaguguaagcagugccggaccaauaucccaauucaacuauaaacaaucauuuucaaacccuacaugccucauccuagcgacaguaccacacaacuuaaccacuauuacgaaaccacuuaaauauagcuacaucaauaaaugcucccguuuacuaucugaugaccgcacggaagucccacaacuuguaaacgcuaaccaauauucuccauguguuagcauuguacccagcacaguuugggaagauggagauuacuauagaaaacaacuuucccccuuagaaggcgggggcugguuaguugcauccggcuccacagucgcgaugacagaacaguuacaaaugggcuuuggaauaacuguacaauaugguacagauaccaacuccgucugcccuaaacucgaguuugcuaaugauacuaaaauugcaagucaauuaggcaauugcguagaauauucgcuuuacggaguaucaggacguggaguuuuucaaaauugcacagcugucggaguacgacaacaacgcuucgucuaugaugcauaccaaaacuuaguuggcuauuauagcgaugauggaaauuauuacugucuacgcgcaugcgucucaguaccaguaucugucauuuaugacaaagaaacgaaaacacaugccacccuauucgggucuguugcaugugaacacaucuccuccacuaugagccaauacucucgaucuacuagaagcauguuaaaaagaagagauucgacauauggaccuuuacagacuccuguagguugcguauuagguuuagucaacucaucucuuuuuguagaagauugcaagcucccauuaggacaaagucuuugcgcacuucccgauaccccaaguacacucacacccagaagcgucagauccguuccuggugaaaugagauuagccaguauugccuuuaaucaccccauacagguggaucaacuuaacuccagcuacuuuaaauugucgauuccuaccaauuuuucauucggcguuacccaagaguacauacaaacaacaauccaaaaaguaacaguagauuguaaacaauauguuugcaacgguuuccaaaaaugcgaacaauuacuaagagaauauggucaauuuugcgcaaaaaucaaucaagcacuccauggugccaaccuacgacaagacgauuccguaagaaacuuauuugcaagcguuaaauccucacaaaguucaccuaucauuccuggcuucggcggagacuucaaccucacucuucuugaacccguaagcauuucaacuggaucacguucugccagaagugcaauugaagacuuauuauucgauaaaguaacaauugccgauccaggauauaugcagggcuaugaugauuguaugcaacaaggacccgcaucagcucgcgauuuaauaugugcacaguauguugccgguuauaaaguucucccaccuuuaauggacguuaauauggaagccgcauauacuagcucucucuuaggaaguauagcaggaguaggauggacugcaggucucaguucuuuugcugcuaucccauuugcccaaucaauauuuuacagacuuaacggaguaggcauaacacaacaaguucuaucugaaaaucaaaaauuaaucgcaaauaaauucaaucaagcccuaggcgcuaugcaaacugguuucacaaccacaaaugaagcauucagaaaaguacaagacgcaguaaauaauaaugcacaagcccuaucuaaacuagcuucagaacucucgaauacuuucggugcuauaucugcuuccauaggcgauauaauacaacgucuugauguucuugagcaagaugcucaaaucgauagauuaauaaauggaagacucacuacacuaaaugccuucgucgcucaacaguuaguucgcucagaauccgcagcccuuucggcacaauuagcaaaagauaaaguaaacgaauguguaaaagcccaaaguaaacgcucaggauucuguggacaaggcacacauauaguuucguuugucgucaaugcacccaauggacuauauuuuaugcacgucggcuauuaucccaguaaucacauagaagucguaucagcauauggauuaugcgaugcggcuaauccgacuaacugcaucgcuccugucaauggauauuucauuaaaacaaauaauacuagaaucgucgaugaauggucauacacaggcucaucauuuuacgcuccagaaccgaucaccagucucaacacuaaauauguugcaccucaaguaacuuaucaaaauauaucaacaaauuuacccccuccccuucuuggaaauucgaccgguaucgacuuccaagacgaacuugaugaauuuuucaaaaaugucagcaccuccauuccaaacuuuggcucacuaacucaaauaaauacaacauuauuagauuuaaccuaugaaauguuaucccuacaacaaguaguaaaagcacuaaaugaaagcuacauugaccuuaaggaauuaggaaauuauaccuauuauaacaaauggccuugguauaucugguuagguuucauagccggauuagucgcacuagcccuaugcguauuuuucauauuauguuguaccggaugugguacuaauuguaugggaaaauuaaaauguaaucguuguugugaucgauacgaagaauaugauuuggaaccucauaaagugcacguacauuaa

SEQ ID NO: 1103 - RNA, 4062 nt, Artificial Sequence
  derived and/or modified CDS sequence (opt6) from MERS-CoV__ALJ54446__S
augauacauucgguauuccuuuuaauguuucuccuuacaccaacugagucauauguugacguugggccggacucaguaaagagcgcaugcauagaaguagauauacagcaaaccuucuucgacaaaacuuggccacgaccuauagaugucucgaaagccgauggcauaauuuauccccaaggccgaacauauucuaauauaacaauaacuuaucaaggacuauuuccauaucaaggugaccacggugacauguauguauacuccgcuggccacgcaacuggaacaacaccacaaaaacucuuuguagcuaacuauucucaagaugucaaacaauucgcaaauggauucguagugaggauaggagcagcagcuaauuccacaggcacaguaauaauaucaccuuccaccucagcaacaaucagaaaaaucuaucccgcuuuuauguuagguucuucaguaggaaacuuuucggauggaaaaaugggaagauucuuuaaccauacauuaguauuauugccagacggcugugggacacuuuuacgagcauuuuacugcauccuugagccaagaucaggaaaucacugcccagcagguaacuuuuauacuuccuuugcgaccuaucauaccccggccacugauugcagugacggaaauuauaaucgaaacgcaucacuuaacuccuucaaagaauauuuuaaucuuagaaacuguacuuuuauguacacauacaauauaacugaagacgaaauacuggaaugguuuggaauaacucaaacugcacaagguguccaccuauuuucuucacguuaugucgaucuauacggaggaaacauguuccaauuugcaacauugccuguguacgauacuaucaaauauuauuccauaauaccccacucuauacggucaauccaaucagacagaaaagcaugggcugccuuuuauguuuauaagcuacaaccacucacauuccuccuugacuuuagcgucgauggauacauaagacgagcgauagauugugguuuuaaugacuuaagccaacuacauuguucauaugaaucauucgacguugaauccgguguauauagcguauccucauuugaagcaaaaccuuccggaucgguuguagaacaagcagaaggcgucgaaugugauuucucaccauuacuuucaggaacacccccacaaguauauaacuuuaaaagacucguauucaccaauuguaacuacaaccuuacaaaacugcucucuuuauucucuguaaacgauuuuaucugcucgcaaaucaguccagccgcaauagcgucaaacugcuauaguucacuaauucucgauuauuuuucuuauccucuaucaaugaaaucagaccucuccguauccucagcaggucccaucucucaauucaauuauaaacaaucuuucuccaauccaacaugucuuauauuagcaacagucccacacaaucuuaccacuauuacgaagcccuuaaaguauucauauauaaauaaguguucacgucuucucucagaugacagaacugaaguuccacagcuaguaaacgcaaaccaauauucaccuuguguuucuauaguuccauccacuguuugggaagacggcgauuacuacaggaagcaacucaguccuuuagaaggaggcggcuggcuagucgcauccggcuccacuguagcaaugacagaacaacuucaaaugggguucggaaucacgguacaauauggaacagauacaaauuccguaugccccaaacuugaauuugcaaacgacacaaaaaucgcaucucaauuagguaauuguguagaauauagccuauacgggguauccgguagagguguauuccaaaauugcaccgccgucggaguaagacaacaacguuucguauacgacgcguaccaaaaccuaguuggauacuauucugaugauggaaacuacuauugucucagagcauguguaucaguaccagucucaguaaucuacgauaaagaaacuaaaacacaugccacucuguucggaucuguagccugcgaacacaucucaucgaccaugucccaauauucuagaucaacucgauccauguuaaaaagaagggauucuaccuacggcccccugcaaacaccaguaggauguguuuuaggucuaguaaauucuaguuuauuugucgaagauugcaaauuaccacucggacagucucuaugugcucugccugauacuccuucaacacuuacacccagaucaguacgaucuguuccuggagagaugagacuagcaucaauugccuucaaccauccaauccagguagaccaacuaaauagcucauacuuuaaauuaucuauucccaccaacuucucauuuggaguuacacaagaauauauacaaacaaccauacagaaaguaacuguagacuguaaacaauacguaugcaacggauuucaaaaaugugaacaauugcucagagaauauggacaguucuguucaaaaaucaaccaagcacuucauggcgccaauuuaagacaagaugauuccguuaggaaccuauuugcuucaguuaaaagcucccaauccucaccaaucaucccaggauucggaggugacuuuaauuuaacgcuccuagaaccuguuucaaucucuacagguagccgaucggcaagaucggcgauagaagaucuacuauucgacaaaguaacaauugcagauccagguuacaugcaaggauacgaugacuguaugcaacaagguccagccucugcaagagaccuaauaugugcccaguacguugcaggauacaaaguccuaccaccacucauggauguaaacauggaagcugccuauacaucuucccuauuaggaagcauagccggaguuggcuggacagccggcuuaucuucauuugcugcaauacccuuugcucaaaguaucuuuuauagacucaacggaguaggaauaacacaacaaguauuaucagaaaaccaaaaacucaucgcaaauaaauucaaucaagcauuaggagcaaugcagaccggcuucacaaccacaaaugaagccuuuagaaaaguacaagaugcgguaaauaacaacgcucaagcacuaucaaaacuggcauccgaacucucgaacacauuuggagcaaucucggcuucaauaggagauauaauacaaagacuagauguacucgaacaagacgcacaaauagaucgucuaauuaauggaagauuaacaacacuaaacgcauucguagcucaacaauuaguacgaucagaaucagcugcuuuaucggcacaacuugcuaaagacaaagucaaugaaugugucaaagcacaaaguaaaagaaguggauuuuguggacaaggaacucacauuguauccuucgucgucaaugcccccaauggacuauauuucaugcauguaggcuauuauccaucaaaccauauagaaguaguauccgcauauggacuaugugaugcagccaacccaacaaauugcauagcaccuguuaauggauauuuuaucaaaacaaacaauacacgcaucguugaugaauggucauauacuggaucaucauuuuacgcuccagaaccaauaacuagccuuaacaccaaauaugucgcuccucaaguaaccuaccagaacauaagcaccaaccuaccuccuccacuacuagguaauaguaccggaauugauuuucaggaugaacuggaugaauuuuucaaaaauguaucuacuucuauuccaaauuuuggaucacuuacacaaauaaauacuacucuacuagauuuaacauacgaaauguuaucuuuacaacaagugguaaaagcucuaaaugaaucuuauauugaucucaaagaacucggaaauuauacauacuauaauaaauggcccugguacauauggcuaggauucauugcaggucucgucgcacucgcauuaugcguauucuuuaucuuauguugcacagguugcgggaccaauugcaugggaaaauuaaagugcaaucgaugcugcgacagauacgaagaauacgaccuagaaccucacaaaguacacguacauuaa

SEQ ID NO: 1104 - RNA, 4062 nt, Artificial Sequence
  derived and/or modified CDS sequence (opt6) from MERS-CoV__ALJ54448__S
augauucacuccguauuccuacuaauguuucuauugacgccuacagaaagcuauguagacguagguccagacucaguaaaaucagcguguaucgaagucgacauucaacagacuuucuuugauaagacuuggccacgaccaauagacguaucuaaagcugacggcauaauauacccgcaagguagaaccuacucaaacauaacaauaacuuaucaaggacuauuucccuaucaaggagaccacggugacauguacguauauagugccggccaugcaacugguacaacaccacaaaaauuauuuguagcaaacuauucacaagaugucaaacaguuugcaaauggauuuguaguccguaucggagcugcugcaaacuccaccgguacaguuauaauaagucccucuacaagcgcaacgauucgaaaaauauauccagcuuuuaugcuagguagcucagucgguaacuuuagugacggaaaaaugggccguuucuuuaaucacaccuugguucucuuacccgacggauguggcacucuacuaagagcauuuuacuguauauuagaaccacguucaggaaaucauuguccugccgguaauucauacacuuccuuugccaccuaucauacaccagcuacagacuguagcgaugguaacuacaaucguaacgcuauucuaaauucauuuaaagaauauuuuaaucucagaaauuguacuuuuauguacacauacaauaucacugaagaugaaauccuggaaugguuuggcauaacccagaccgcacaaggaguucacuuauuuucuucacgcuaugucgaccuauauggagggaacauguuucaauuugcaacacuaccagucuaugauaccauaaaguacuauucuaucaucccacauaguauacguucuauacaguccgacagaaaagccugggcagcauucuaugucuacaaauuacaaccacuaacuuuucuucuagacuuuucuguagauggcuauauacgcagagccauagacugcggauucaaugaccuuucacaacuacauuguucauaugaaucauucgacgucgagagcggaguauauuccguaucuagcuuugaagccaaaccaagcggaaguguuguagaacaagcugagggcguugagugugacuucucuccucuacuaucagguacuccaccacaaguauauaauuuuaaacgauuagucuuuacaaauuguaacuauaaccucacaaaacuccuaucacuuuuuaguguaaaugauuucacaugcucucaaauauccccugcagcaauagcuagcaauuguuauaguucucucauacuagauuacuuuucauacccacucucuaugaaaucagauuuaucaguuucaucagcaggcccaauuucacaauucaauuacaaacaaucauuuucaaacccgacaugcuuaaucuuagcaacagugccucauaauuuaacaacuauuaccaaaccacucaaauauucauauaucaacaaauguucgcgauugcucucggaugauagaacugaaguaccucaauuagugaaugcaaaccaauacagucccuguguaucaauaguaccaucaacagucugggaagacggagauuauuaucgaaaacaacuaaguccuuuagaaggcggcggaugguuaguugcaucuggaucuaccguggcgaugacagaacagcuacaaauggguuuugguauaaccguucaauacggaaccgauacaaauucuguuugcccuaaacuugaguucgcaaacgacacaaaaaucgcuucgcaacugggaaauuguguugaauacucacuauauggagugaguggcagaggaguauuucaaaauuguaccgccguuggaguacgccaacaacgcuuuguuuacgaugcuuaucaaaacuuaguuggauacuauagugaugauggaaacuauuauugucuacgagcaugugucucuguaccuguaucaguuaucuaugauaaagaaacaaaaacccacgccacuuuauuuggaagcguugcuugcgaacauaucucaucaacaaugucccaguacucuagaagcacacgcucaaugcuuaaacgaagagauucaaccuacggaccacuacaaacaccaguaggcuguguccugggacucguaaacuccagccuuuucguagaagauuguaaacuuccacuuggucaaucacucugugcucuaccugacacacccagcacacuaacaccaagaucgguaagaagugucccuggcgaaaugaggcuugccucaauagcuuuuaaucaccccauccaagucgaccaacuaaauucgaguuacuuuaaacuuucaauaccaacaaacuucagcuucggaguuacucaagaauauauacaaacaacaauucagaaaguuacaguagauuguaaacaauauguaugcaacggauuucaaaaaugcgaacaauuauuaagagaauauggccaauucuguuccaaaaucaaucaagcucuacauggugcuaacuuaagacaagacgauuccguacguaacuuauucgcauccguaaaaagcucacaaucuucgcccauuauaccggguuuugggggugauuucaaccuaacccuucucgaaccuguauccaucucaaccggcagcagaucagcuagaucagcaaucgaagaucuacuuuuugauaaaguaacgauagcagaccccggauacaugcaaggauaugacgacugcaugcaacaaggcccagcaucggcuagagaucuaaucugcgcacaauauguagcaggcuacaaaguccucccaccacucauggauguaaauauggaagccgcguacacuagcagccuacuugguucuaucgcaggcguuggauggacagcaggccucaguagcuuugcggcuauucccuuugcucaaagcauauucuaucguuuaaacggcgucggaauaacucaacaaguccugagugaaaaucaaaaauuaauagcuaauaaauuuaaucaggcuuuaggugcuaugcaaacaggcuucacaacuaccaacgaagcauuuagaaaaguucaagaugcuguuaauaauaacgcucaagcucuuuccaagcuggcuucugaauuaucaaauacauuuggagcuauaucugccaguauaggagacauaauucaaagacuagauguacuagaacaagaugcccaaauagauagacuuauaaauggccgucuaacgacacuaaaugcauucgucgcacaacaauuaguuagauccgaauccgcugcauuaucugcacaacuugcaaaagauaaaguuaacgaauguguaaaagcacaaucaaaacgaucaggauuuuguggccaagguacucacauaguauccuucguuguaaacgcacccaauggacuuuacuuuaugcacguaggauauuauccuucaaaccauauagaaguaguaucagccuauggccuaugcgacgccgcaaaccccaccaauugcaucgcuccuguuaacggcuacuucauaaaaacaaauaacacacgaaucguugaugaauggucauacacugguucaucauucuacgcaccagaaccaauaacaagucuaaauacuaaauauguagcuccgcaaguuacuuaucaaaacauaucaacaaaucuaccaccuccucuacuuggaaauucaacagguauugauuuccaggacgaauuagaugaauuuuucaaaaauguaucaaccucuaucccuaacuuuggaagccuuacucagaucaacacaaccuuauuagauuuaacauacgaaaugcuaucccuucaacaaguuguaaaagcauuaaacgaaucuuauauagaucuuaaagaacuaggcaauuauacauauuacaauaaauggcccugguauauuuggcuaggcuuuauugccggauuaguagcauuagcacuaugcguauuuuucauuuuaugcuguacaggauguggcacaaauugcauggguaaauuaaaauguaauagauguugcgaucgcuaugaagaauaugacuuagaaccacacaaaguucauguccauuaa

SEQ ID NO: 1105 - RNA, 4062 nt, Artificial Sequence
  derived and/or modified CDS sequence (opt6) from MERS-CoV__ALJ54450__S
augauacauucugucuuucuacugauguuccuauuaacaccuacugaaucguauguggauguuggaccagauucaguaaaaagugcaugcauugaaguugacauccaacaaacauuuuucgacaaaacuuggccuaggccaauagauguaucaaaagccgauggaaucaucuauccacaaggccgaaccuauucaaacauaacuaucacauaucaaggccuauucccauaccaaggagaccauggcgacauguacguguauucagcaggccacgcaaccgguacaacaccccaaaaguuauucguggcaaacuacucucaagauguaaaacaguucgcaaauggauuuguaguuaggauuggagcagcugcaaacucaaccggcacuguaauaauaucuccaaguaccuccgccacaauccguaaaauuuacccagcauuuaugcuuggaucaucaguuggaaacuuuucugauggcaaaauggggagauucuuuaaucacacccuaguucuauuaccagauggaugcggcacacuauuaagagccuucuauugcauacucgaaccucgaucgggaaaucacugcccagcuggcaacuccuauacaucuuuugcaacuuaccauaccccugcaacagacuguucugaugguaacuacaaucgauaugcuucuuuaaauucuuuuaaagaauauuucaauuuacguaauuguacauuuauguauacauauaacauaacggaagacgaaauuuuagaaugguuuggaauaacccaaacagcccaaggaguucaucuauuuucaucuagauacgucgacuuauauggagguaauauguuccaauucgcaacacuaccaguauaugauaccauaaaauacuauucaauaauaccccauaguauucgaucaauccaaagugaucgaaaagcaugggcugcuuucuauguuuauaaacuacaaccgcuuacauuccuauuagauuuuuccguagauggcuauauacgucgcgcaauagacuguggauucaacgaccucucucaacuacauugcucauaugaaucauuugauguagaaucuggagucuacucggucucauccuucgaagcaaaacccuccgggucaguaguagaacaagcagaaggcguugaaugugauuuuagcccacuauuaucagguacaccgccacaagucuauaauuuuaaacgccuaguauucacaaauuguaacuacaacuuaaccaaguuauuaucccucuucucggucaacgacuucacaugcucccaaaucucuccagcugcuauagcuucuaacuguuauucaucccucauacucgauuauuuuucauauccacuuucaaugaaaagugaucucagcguuagcuccgcaggaccaauuucucaauucaauuacaagcaaucauucucuaauccgacaugcuuaauacuagccacgguaccacauaaucucaccacgauaacaaaaccacuaaaguauucguauauaaacaaauguaguagacucuuaagcgacgaucgcacagaaguaccccaacucguaaacgcaaaucaauacucccccugcgucucaauaguaccaagcacuguaugggaagauggagauuauuaucgaaaacaauuaucuccccuagaaggugguggauggcuuguagccucagggucuacaguagccaugacugaacaauuacaaaugggauuuggaaucacaguacaauacggcacagauacaaauucggucuguccaaaauuagaauuugcuaaugauacaaaaauagcuucgcaacuaggaaacugugucgaauacagccuauauggagucuccggcagaggcgucuuccaaaacuguacugcagucgguguucgucaacaacguuucguauaugacgccuaccaaaaucuaguuggauacuacuccgacgaugguaauuacuacugccuacgggcauguguuucuguaccaguauccguuauauaugauaaagaaacaaaaacacacgcuacccucuucggaaguguagccugugaacauaucucaaguaccaugagccaauacucaagguccacaagauccaugcugaaacguagggacaguacauacgguccccuacaaaccccaguugguugcguacuaggucuaguaaacuccucuuuauucguugaagauuguaaacucccacuaggucaaagccuuugcgccuuaccagauacuccauccacacuaaccccacgaagcguucgaucaguucccggagaaaugagacuggcaucaauagcuuucaaccacccgauucaaguugaucaacucaauagcucauauuuuaaacuaucaauacccaccaauuuuaguuuuggaguaacacaggaauauauacaaacuacgauacaaaaaguuacugucgauuguaaacaauauguaugcaacggauuucaaaaaugcgaacaauuauuacgugaauacggacaauucuguucaaaaauaaaucaagcccuacacggagcuaaccucagacaagaugacuccguucgcaaucucuucgcuucugucaaauccucacaaucuucucccaucauacccggauuuggaggcgauuucaaucuuaccuuauuggaaccuguuuccauaucuacaggaaguagaucugcacggucagccauagaagaccuacuauucgauaaaguaacaauugcugauccuggcuacaugcagggauaugacgauugcaugcaacaaggaccugcuagcgcgagagaucuaauaugcgcucaauauguagccggauacaaagucuugccaccacugauggauguaaacauggaagcugcauacacaagcucucuucuaggaucuauagcaggaguaggauggacagcaggacuauccucauuugccgccauacccuuugcccaauccauauuuuaucgucuuaauggaguagguauuacccaacaaguuuuaucugaaaaccaaaaacuaauugcaaauaaauucaaucaagcucuuggggccaugcaaacuggauucacaacuacgaaugaagcauuccggaaaguacaagaugccguaaacaacaaugcacaagcccuuucuaaacuagcauccgaauuaucuaauacauuuggcgccauuucagcaucuauaggcgacauaauacaaagacuugacguccuagaacaggacgcucaaauagacagauuaauaaauggccgucucacuacacuaaacgcauuuguagcacagcaauuaguuagaucggaaucagcagcacuuucagcacaacuagccaaggacaagguuaacgaauguguaaaagcacaaaguaaacguucugguuucuguggucaaggaacccauauuguuaguuuuguaguaaacgcaccaaaugguuuauauuuuaugcauguagguuacuauccuuccaaccauauagaagucgucucagcauacggacuaugugacgccgcuaauccaacuaauuguauugcacccguuaauggcuauuuuauuaaaaccaauaacacaagaauagucgacgaauggucauauacggguucaaguuuuuacgcaccagaaccuaucacaagccucaacacuaaauacguagcgccucagguuacauaucaaaauaucucaacuaaucuacccccuccucuacuaucaaauucuaccgguauagacuuccaagacgaauuagacgaauuuuucaaaaauguaucuacaucuauacccaacuuuggaucacuuacucaaauuaauacaacacuccuugaucuaacuuacgaaaugcuuagccuacaacaaguuguuaaagcccuaaacgaaucauauaucgaucuuaaagaauuaggcaauuacacuuauuauaacaaguggccuugguauaucugguuggguuucaucgcaggauuaguggcuuuagccuuauguguauucuuuauucucuguuguacuggauguggaaccaauuguaugggcaaguuaaaauguaaccgauguugcgacagguaugaagaguacgacuuagaaccacacaaaguacauguacauuaa

SEQ ID NO: 1106 - RNA, 4062 nt, Artificial Sequence
  derived and/or modified CDS sequence (opt6) from MERS-CoV__ALJ54453__S
augauccauucuguauucuuacuaauguuucuccucacaccaacagaaucauacgucgacguuggaccagacucuguaaaaucagcuuguauagaaguugauauacaacaaacauucuucgauaaaaccuggccuagaccaauagauguuuccaaagcggacgguauuauauauccacaagggagaacuuacuccaauauuacaauaacauaucaaggucuauucccauaucagggcgaccauggugauauguauguauauagugcaggccacgcaacuggaacaacaccccaaaaacuauuugucgcuaauuauucacaagauguaaagcaauuugcuaacggcuucgucguucgcaucggagccgcagcuaauucaacagggacgguuauaaucaguccuuccaccucagcaaccauccggaaaaucuauccagcauuuaugcuaggaucauccguuggaaauuuuucagaugggaaaauggguagauuuuucaaucauacacugguccuacuacccgacggaugcgguacacuucuaagagcauuuuauuguauacuagaaccuagaagcggaaauuauugcccagcagggaacucauacaccucauuugcaacauaccacacacccgccacugacugcucugacggaaacuauaaucgaaaugcuucacuaaacucuuucaaagaauauuuuaaccuuagaaacuguacauuuauguauacauauaauauaacagaagacgaaauucuugaaugguucgggauuacccaaaccgcucaaggaguacaucuauucucgaguagguacgucgaucuauaugguggaaacauguuucaauucgcaacccuuccugucuaugauacaauaaaauacuacuccauaauaccccauaguaucagaucuauacaaucagauagaaaggcuugggcagcuuucuauguauauaaauuacaaccacuaaccuucuuacuagacuuuucaguagauggauacauacgacgcgcaauagauugugguuucaaugaccucucccaauuacauugcaguuaugagagcuuugacguagaauccggcguuuauagcgucagcucuuuugaagcaaaacccucagguucaguagucgaacaagcugaaggcguagaaugugacuucucaccacuccuaucagguacacccccucaaguauauaacuucaaaagauuagucuuuacuaauuguaauuauaauuuaacaaaacuucuaucuuuauuuuccguuaaugauuuuaccugcucucaaauuucaccagcagccauugcaaguaacuguuauucuagccucauacuagacuauuuuuccuauccacucucaaugaaaucagacuuaucuguaucaagugcggguccuauuucccaguuuaacuauaaacaaucauucuccaacccgaccugucucauacuagcuacaguaccccauaacuuaacuacgauaacgaaaccacuaaaauacucuuauauuaauaaaugcagucgacucuuaucugaugauagaacagaaguuccacaacucguaaaugcaaaccaauacaguccauguguuucuauaguaccauccacaguaugggaagauggagauuacuaccgaaaacaacuaucaccguuagagggcggagguugguuaguugcaucuggauccacaguagcaaugacggagcaacuucaaaugggcuuuggaauaaccguccaauacgguacggauacaaacagcguuugccccaaauuagaguucgcuaaugacacaaaaaucgcuucucaacuaggcaacugcguagaauacagcuuauauggcguaucuggcagaggcguuuuccaaaacuguacugcugucggcguaagacaacaacguuucguauacgacgcauaccaaaaccuugucggcuacuauagcgaugauggaaacuacuacugccugcgagccuguguuucaguucccguaaguguuauauaugauaaagaaacuaaaacacacgcaaccuuguuuggaucgguagcaugugaacacauaucaucaacaaugucacaauacucacgaucaacacggucaaugcuaaaacgucgagauucuaccuauggcccucuucaaacaccaguuggaugcguauuaggucuaguuaauucaucacucuucguagaagauugcaaacuuccauuaggccaaaguuuaugugccuuaccagacacaccaagcacacucacgccccgguccguacgcucaguacccggagaaaugagacucgcuuccauagcguuuaaucauccaauccaaguagaccagcuaaauuccuccuauuuuaaauuaucgauacccacgaauuuuucauucggaguaacccaagaauauauacaaacaacaauucaaaaaguaaccguagauuguaaacaauacguaugcaauggcuuucaaaaaugugaacaauuacuuagagaauacggacaauucuguucuaaaauuaaucaagccuuacauggcgcaaacuuaagacaagacgacuccguacguaaucuauuugccuccgucaaauccucgcaaucaucaccuauuauaccaggauucggcggagauuuuaaucucacuuuacuugaaccagucuccauauccacuggaucacgaucagcaagaagugccauugaagacuuacuguuugauaaaguaaccauugcagacccuggcuacaugcaaggguacgacgauugcaugcaacagggaccugcuucagcucgagaucucauuugugcucaauacguagcaggauauaaaguucugcccccuuuaauggacgugaauauggaagcagccuauacuagcucccuauuaggauccauagcagggguuggcuggaccgcugguuuaucaaguuucgccgcaauaccuuuugcucaaucgauauucuauaggcuaaauggaguaggaauaacucaacaaguauuaagugaaaaccaaaaacuaaucgcaaauaaauuuaaucaggcuuuaggugccaugcaaacaggauucacuacuacaaaugaagccuuucgaaaaguccaagaugcaguuaacaauaaugcccaagcucucuccaaauuggcauccgaacuauccaacacauucggagccauuucagccaguauaggagauauuauacaacgucucgauguucuagaacaagaugcacaaaucgauagacucauaaacggaagacuaacaacacuaaacgcuuucguagcacaacaacuugucaggucagaaucagcugcacuuagugcucaauuagcgaaagacaaagucaaugaaugcguaaaagcacaauccaaacguagcggcuuuuguggucaaggaacucacauaguaucguucguuguaaaugcccccaaugggcuauauuuuaugcacguuggauauuacccauccaaucauaucgaaguagucucagcauauggccuaugugaugccgcaaauccaacaaauuguauagcaccuguuaauggauacuuuauaaagacaaauaacacccgcauaguugaugaguggucauacacagguucauccuucuaugcacccgaaccaauuacaucuuuaaacaccaaauauguggcuccucaaguaacauaccaaaauauaagcacaaauuuaccgcccccacuauuagguaacucaacaggaauugauuuucaagacgaguuagacgaauuuuucaaaaacgugaguacaucaauaccaaacuucgguuccuuaacccaaauaaacaccacauuacucgaucuuaccuacgaaauguuaucuuuacaacaaguaguuaaagcucuaaacgaaagcuauauagaucuuaaagaacucggaaauuacaccuauuacaauaaauggccuugguacauauggcuuggauuuauugccggucuaguagcacuugcuuuaugcgucuuuuucauuuuauguuguacaggauguggaaccaacuguaugggaaaauuaaaaugcaauaggugcugcgaccgauacgaagaauaugaucuugaaccacauaaaguccauguucacuga

SEQ ID NO: 1107 - RNA, 4062 nt, Artificial Sequence
  derived and/or modified CDS sequence (opt6) from MERS-CoV__ALJ54455__S
augauacacucaguauuucucuuaauguuucuauuaacaccaacagagagcuacguagacguaggucccgauucaguaaaauccgccuguauagcuguagauauacaacaaacauucuucgacaaaacuuggccaagaccaauugauguaucaaaagccgacgggauuauuuauccccaaggacgaacauacucaaauaucacaauaacauaucaaggucucuucccuuaucagggagaucacggagacauguacgucuauucagcaggacacgcaacagguacuacaccacagaaacuuuucguugcaaauuacucucaagaugucaaacaauucgcuaauggguucguaguaagaauaggagcggcugcgaacucaacuggaaccguaauuauaucaccaagcacaucggcuacaauccgcaaaauuuauccagccuucaugcucgguucaucgguaggcaauuuuuccgauggaaaaauggguagauuuuucaaucauacccuugucuuacuuccagauggcugcgggacacuauuacgcgcauuuuauugcauauuagaaccucgaagcggaaaucauuguccugcaggaaacucauacacaucauuugccacauaccacacuccagcaacugacuguucagauggaaauuacaaucgcaaugcuucauuaaauuccuucaaagaauacuuuaaucuacguaacuguacuuuuauguacacauauaauaucacagaggaugaaauauuagaaugguucggcauaacucagaccgcucaaggaguucaucuauucucaucacguuaugucgaucuauauggaggaaauauguuucaauucgcaaccuuaccuguauaugacacaauuaaauauuauucaauaaucccccauuccauaaggucaauucaauccgaccguaaagcaugggcagcauuuuacgucuacaaauuacaaccucucacauuuuuauuagacuucagugucgauggcuacauacgcagagcuauugauuguggauucaaugacuuaagucaacuacacuguucuuacgaaucuuuugacguagaaagugguguauacagugucucuaguuuugaagcgaaaccuucgggcucugucgucgaacaagcugaaggaguugagugcgacuucagcccucuacuaucaggaacaccaccacaaguuuacaauuucaaacguuuagucuucacaaacuguaauuauaaucuaacaaaauuacucucacuauuuucaguaaaugacuucacuuguucccaaauuuccccggcugcuauagcaucuaauugcuacucuucgcuaauucuagauuauuucucuuauccacuuuccaugaaauccgauuugagugugucaucagccgguccaauaucucaauuuaacuauaagcagagcuuuuccaaucccacaugccuuauacuagcgacaguuccucauaaccucacuacuauaacuaaaccacuaaaauauucguacauaaacaaguguagccgacuauuguccgacgauaggacagaagugccccaacucgucaacgcaaaucaauacucuccguguguaagcauaguaccuucaacaguuugggaagauggugauuauuauagaaaacaacuaucuccacucgagggcggaggaugguuaguggcuaguggaaguacuguugcgaugacagaacaauuacaaaugggguuuggaaucacuguacaauauggaaccgacacaaacucagucugccccaaguuagaguuugcuaaugauaccaaaauagccucacaacuaggaaauugcguugaauacucacuauauggaguaucagguagaggcguauuucaaaacuguacugccguagguguacgacagcaacgguucguauaugacgcauaucaaaaccuaguuggcuauuauucagaugauggcaauuacuacugucuaagagcauguguaagcguaccaguaucaguaauuuaugauaaagaaacaaaaacacacgccacacuauucggaucaguagcaugcgaacauauuagcucaacuaugucccaauauagucgaucaacuagauccaaacuuaaacggcgcgacagcacauaugggccucuucaaacuccaguaggcuguguacuaggauuagucaauucaucacucuuuguagaagacuguaaauugcccuugggacaaucucuaugugcacuccccgauaccccaagcacacuaaaaccaagauccguccgcucaguaccaggagaaaugcgacuugcuagcaucgccuuuaaucacccuauucaaguagaccaauuaaauuccucuuacuuuaaauuaucuaucccaacuaacuuuaguuuuggagucacucaggaauauauccaaacaacgauacaaaaaguuaccguggauuguaaacaauacgugugcaauggauuucaaaaaugugaacaauuauuacgagaauacggacaauuuugcucuaaaauaaaucaagcacuacacggagcaaacuugcgacaagaugauucaguuagaaaucuauucgcaucaguaaaaucuucucaaucuuccccaaucauaccaggauucggaggugauuucaaccuaacacucuuagaaccagucucgauuuccacugguagcagguccgcaagaucugcaauagaagaucuucuuuucgacaaaguuaccaucgcggacccaggauacaugcaaggauacgaugacuguaugcaacaaggcccagccucugcucgagacuuaaucugcgcucaauacgucgcuggcuauaaaguauuacccccucucauggauguaaauauggaagccgcauacacaucgucucuauugggcucaauagcaggcguugguuggacagcuggccuaaguucauuugcagcaauucccuucgcucaaucuauauucuaccgacuaaacgguguuggaauaacccaacaaguauuaucagaaaaccaaaaacuaauagcaaacaaguuuaaucaagcucuuggcgcuaugcaaacaggcuuuacaaccacaaaugaagcauuuagaaaagugcaagaugccguaaauaauaacgcucaagcucuaucuaaauuagcaucugaacuaagcaacacauuuggugccauuucagccaguauuggagauauaauucagcgucuagacguucuagaacaagaugcacaaauagaccgauugaucaauggccggcuuacaacuuuaaaugccuucguagcucaacagcuagucagauccgaaucagccgcccuaagugcucaauuagcuaaggacaaagucaaugaauguguaaaggcccaauccaaacguucuggauuuugcggucaaggcacucauaucguauccuucguaguaaaugcaccuaacggccucuacuucaugcauguaggauacuacccaucgaaccacauagaaguagugagugccuacggcuuaugugaugcagcaaacccuacuaacugcauagcuccagucaacgguuacuucauaaagaccaacaauacaagaauuguggacgaauggaguuacaccggaucuucauucuaugcaccugaaccaauaacuuccuuaaauacaaaauauguagcaccccaaguaacauaccaaaauaucagcacuaaucuuccaccaccacuucuagguaacucuaccggaauugauuuccaagaugaacuagaugaauuuuucaaaaacgugucaacuucuauuccaaauuuuggaaguuuaacccaaauaaacacaacccuauuagacuuaacuuaugaaauguuaucgcuccaacaagucguaaaagcacucaacgaaucauauaucgaucuaaaagaacuaggaaacuauacauauuacaacaaauggccaugguauauauggcucgguuucauagcaggccuagucgccuuagcccuaugugucuuuuucauauuaugcugcacaggaugugggacaaacugcaugggaaaacuaaaauguaacagaugcugugaucgauacgaagaauaugauuuggaaccucauaaaguacacguacacuga

SEQ ID NO: 1108 - RNA, 4062 nt, Artificial Sequence
  derived and/or modified CDS sequence (opt6) from MERS-CoV__ALJ54456__S
augauacacucugucuuuuuacuaauguucuuacucacuccaacugagucuuacguagauguaggaccagacuccguaaaaucagcaugcauagcuguagauauacaacaaaccuucuuugacaagacuuggccacgucccauugacguuucaaaagccgaugguauaauuuauccucaagguagaaccuacucaaauauaaccauuacauaucaaggacucuucccauaucaaggagaccauggugauauguacguuuauagcgcuggucaugcaaccggaacuacuccucaaaaacuuuuuguugcaaauuauucacaagaugugaaacaauuugccaaugguuuugugguaagaauaggagccgccgcaaauagcacaggcacuguaauuauuuccccaaguaccagugcuaccauaagaaaaauauacccugcuuuuaugcuaggaagcucagucggaaauuuuucugauggaaaaaugggcagauucuuuaaccacacacuuguucuacuuccagacggcugugguacacuacuacgagcauuuuacugcauccuugaacccagaaguggcaaucauugcccagcuggaaacuccuauacuucuuuugcaacauaccacaccccagcuaccgauuguucugacgguaauuauaaccgaaacgcaucucuaaacucuuucaaagaauauuuuaaccuccgaaacugcaccuuuauguacacuuauaacauaacagaagacgaaauacuagaaugguucggcauaacacaaacagcacaagguguccaucuauuuucuagccgcuauguugaccucuacggagguaauauguuucaauucgccacauuaccuguuuacgauacaauuaaauauuauucuauuauaccacauucuauaaggagcauucaguccgaccgcaaagcaugggcugcauucuacguauauaaauuacaaccauuaacauuuuuacuugauuucucuguagauggauacaucagacgcgccauagauugcggcuuuaaugauuugagccaauuacacuguucuuacgaaucauucgacgucgaaucgggaguguauuccguuucaucuuucgaagcaaagccaucggguucaguuguagaacaagcugaagguguugaaugcgauuuuuccccacugcuuucagguacacccccacaaguauauaauuuuaagaggcuaguauucacaaauuguaauuacaauuuaacuaaacuacuaucgcucuuuucuguaaaugauuuuacauguucacaaauauccccagcugcaauagccaguaauugcuacucaucuuuaauauuagauuacuuuucuuacccacucuccaugaaaucggaccuuuccguaucaagugcuggucccauuucccaauucaauuauaaacaaucauuuucaaauccaaccugucuaauucuugcaacagucccucacaacuuaacuacaauuacaaaaccacuuaaauacuccuauauaaacaaauguucucgcuuacucucagacgaucgaaccgaaguuccgcaauuaguuaaugcaaaccaauacucccccugcguaaguaucgucccaucuacuguuugggaagauggugacuauuauagaaaacaacucucaccacuagaaggcggagguuggcucguggcaaguggauccacuguugccaugacagaacaacuacaaaugggauuugguauuacaguccaauacgguacggacacuaacagcguaugcccuaaacuugaauuugcuaacgauacaaaaaucgcaucucagcuuggcaauuguguagaauauagucuuuauggaguuucgggccgaggagucuuucagaauuguaccgcaguaggugucagacaacaacgauuuguuuacgaugcuuaucaaaaucuagucggauacuauucagaugauggaaacuacuacuguuuaagagcaugcgucucugucccaguaucaguaaucuaugauaaagaaacaaaaacccacgcaacucucuuuggaucugucgcuugugaacauauaucuucaacuaugucacaguauuccagaucuacucgauccaugcuaaaacgaagagauucaacauauggaccucuacaaacucccguuggaugcguucucggccuagucaacucaagucuauuugucgaagauuguaaacucccacuaggacagagcuuaugcgcacuaccugacacaccuuccacacuaaaaccacgcaguguaagaagcgucccgggugaaaugcgauuagcaucaauagccuucaaccacccgauucagguagaucaauuaaauucauccuacuuuaaacuaaguauuccaaccaauuuuucuuucgggguaacucaagaauauauacaaacaacaauccaaaaagucacugucgacuguaaacaauauguuugcaacggcuuucaaaaaugugagcaauuacucagagaauauggacaauuuuguucaaaaauaaaccaagcauuacauggggcuaaccuacgacaagacgacucaguacgaaaucuuuucgcauccguaaaauccagucaaaguucuccaaucauaccgggauuuggaggugauuuuaaccucacccuauuagagccaguauccaucuccacuggaucaagauccgcucguagugccaucgaagauuuauuauucgacaaagugacuauagccgacccuggauacaugcaaggauacgacgauugcaugcaacaaggaccagcaucagcuagagauuuaauuugcgcucaauauguggcugguuacaaaguguuaccacccuuaauggauguaaacauggaagcugcguauaccucuucacuauugggaucaauugcugguguaggauggaccgcaggauuauccuccuuugcugcaauaccuuuugcacaauccauauuuuauagacuuaacggaguagguauaacccaacaaguccuaucugaaaaccaaaaacuaauagcaaacaaauucaaucaagcacucggugccaugcagacugguuucacaacaacaaaugaagcauuccgcaaaguacaggacgcaguaaauaauaaugcacaagcauuaucaaaacuagccucugaacucagcaauaccuucggugcuauauccgcaucuauuggcgauauuauucaaagguuagauguucuagaacaagacgcacaaauugacagauuaauaaauggaagacuuacuacccuuaaugcuuucguagcacaacagcuagucagaagugaauccgcggcuuuaucugcccaacuagcaaaagauaaaguaaaugaauguguaaaagcacaaucaaagagaucuggcuuuuguggacaaggaacucauauuguuagcuucgugguaaacgccccaaacggcuuauauuucaugcauguaggauauuauccaagcaaccacauagagguuguuuccgccuacggacuaugugaugcugcuaacccaaccaacuguauagcuccaguaaacggcuauuuuauaaaaacaaacaauacucguauaguagacgaauggucauauaccggaucuucauuuuaugcaccagaaccaauaacaucacuaaauacuaaauauguagcaccccaaguaacuuaccaaaauauuuccacaaauuuaccaccuccccuccucggaaacucuacuggaaucgauuuccaagaugaacuagacgaauuuuucaaaaauguuagcacauccauacccaacuucggaucucuaacucaaauuaauaccacacuguuagacuuaacauacgagauguuauccuugcaacaaguaguaaaagcccugaacgaaucauauauagauuugaaagaauugggaaauuacaccuacuauaacaaauggcccugguacauaugguuaggauuuauagcuggacucguugcucuugccuuaugugucuucuucauccuaugcugcacaggaugcggaacgaauuguaugggcaaacuuaaaugcaaccgauguugugaucgcuaugaggaauaugauuuagaaccccacaagguacauguucacuaa

SEQ ID NO: 1109 - RNA, 4062 nt, Artificial Sequence
  derived and/or modified CDS sequence (opt6) from MERS-CoV__ALJ54461__S
augauucacucaguuuuucuauuaauguuuuuauuaacuccaacagaaucauacgucgacguaggacccgauuccguaaaaccagcauguauugaaguagacauucaacaaacauucuuugauaaaacauggccaagaccaauagauguaucaaaagccgauggaauuaucuauccccaaggucgaaccuacucaaacauaacuaucacauaucaaggcuuauuuccauaccaaggagaucauggugauauguacgucuacucugcaggacacgccacgggaacuacaccacaaaaacuauuuguagccaauuacucucaagauguaaaacaauuugcaaacggauuuguuguaagaaucggcgccgccgcuaacucuacugguacaguaauaauaucaccaucuaccucagcuaccaucaggaaaauauauccugcuuuuaugcuuggaucuuccguaggcaacuuuucugaugguaaaaugggacguuucuuuaaccauacucuaguacuauugcccgauggcuguggaaccuuacuaagagccuuuuauugcauccuugaaccuagaaguggaaaccacugcccagcaggcaauuccuacacauccuuugcuacauaucacacaccagcaacagauuguucugacggcaauuacaauagaaaugcauccuuaaacucuuuuaaggaauauuuuaaccuucguaacugcacauucauguacacauauaacauaaccgaagacgaaauacucgaaugguuuggaauaacucaaacagcacaaggagugcaucuauuuuccucacgcuacgucgauuuguacggagguaauauguuucaauucgcgacucuacccguuuacgauacaauaaaauacuacuccaucauaccacauucuauuagaucaauacaaagcgacagaaaagccugggcagcuuuuuacguauauaaacuacaaccccuuacauucuuacucgauuuuucaguugauggauauaucagacgagcaauagacuguggauuuaaugacuugucucaacuccauugcucauacgaaucauuugauguagaaucaggcgucuauucagucucuucuuuugaagcaaaaccaucaggaucagucguugaacaagcggaaggaguagaaugugauuuuucaccuuuauuaaguggaacaccaccacaaguauacaauuuuaaacggcuaguauucacuaauuguaauuauaaucuuacaaaacucuuaucauuauucuccgucaaugauuuuacuugcucccaaauaucgccugcagccauagcuuccaacuguuauuccucccuaauacuggauuauuuuagcuauccacucucaaugaaauccgaccucucaguaacaagcgccggucccauaucccaauucaauuacaaacagagcuuuaguaauccaaccuguuuaauuuuagcuacuguuccucauaaucuaacaacuauuacaaaaccuuuaaaauauucuuauaucaauaaaugcagccgauuauugucagacgacaggaccgaaguuccacaacucguaaacgcaaaucaauauucaccaugcguuaguauaguuccgaguacaguuugggaagacggcgauuauuaucgcaaacaauuaucaccucuugaagguggaggauggcuagucgcaucugguaguaccguagcuaugacagaacaacuacaaauggguuucggaauaacaguccaauacgguaccgacacuaauuccguaugcccaaaacucgaguucgcaaaugacacgaaaauagcuucacaacuuggcaauugugucgaauauucucuauauggaguaucaggaagaggcgucuuucaaaacugcacagcagucggcguacgacaacaaagauuuguguaugaugcuuaccaaaaccuuguaggcuacuacucagaugacggcaauuacuauugccuucgagcaugugucucgguuccugucaguguaauauaugacaaagaaacuaaaacccaugcaacccucuucggaucuguagcaugugaacauauuaguuccacgaugucccaauacucaagaucaacacgcuccaugcuuaaacgacgggauucaacauacggcccccugcaaaccucuguaggauguguuuugggucucguaaauuccucacuuuucgucgaagacuguaaauuaccauuaggacaauccuuaugugcgcugccggacacacccucaacauuaacaccaagaucuguucgaagcgugccaggugaaaugagauuagcuucuaucgcuuucaaucauccaauacaaguugaucaauuaaacucgucauauuuuaaacuaucgauacccacuaauuuuaguuuuggggucacccaagaauacauucaaacuacuauacaaaaagucacaguagacuguaaacaauacguaugcaauggauuccaaaaaugugaacaacucuuaagagaauauggucaauucuguuccaaaauuaaucaggcauugcauggagcaaaccuacgucaggacgauuccgucagaaaucuauuugcaucagucaagucaucacaaucuaguccgaucaucccuggauucgguggagauuucaacuuaacacuccucgaaccagucuccauaucaacaggaucacgaagcgcuagaucagcuauagaagaccuacuauucgauaaaguaacaaucgccgacccaggauacaugcaagguuaugaugacugcaugcaacaagguccugccagugcacgagacuugaucugugcucaauacguugcggguuauaaaguucuaccaccacucauggacgucaauauggaagcagcauacacuagcucuuuacuggggucaauagcaggcgucggauggaccgcaggcuuaucuuccuuugccgcuauacccuucgcccaaaguauauuuuauagacuaaauggaguugguaucacacagcagguuuugucagaaaaccaaaaacucauagcaaauaaauuuaaucaagcacuuggagcaaugcaaacuggcuucaccacaaccaaugaggcuuuucggaaagugcaagaugccguuaauaauaaugcucaagcauuaaguaaacucgcaucagaauuaaguaauacuuuuggcgccaucuccgccuccauaggagauauuauucaacgacuagacguccuagaacaagacgcucaaauagaucgcuuaaucaacggcagacucacaacacuaaaugccuucguagcccaacaauuaguacgaucugaaucagcugcacuuucagcacaacuagcaaaagauaaaguaaacgaaugcgucaaagcucaaucaaaaaggucgggauuuugcggacaaggcacccacauaguaucauucguagugaacgcacccaauggccuauacuuuaugcauguaggcuacuauccauccaaccacauagaaguaguaucagcuuacggacugugcgaugccgcuaauccaacaaacugcaucgcgcccguaaacggauauuuuauaaagacaaauaacacaagaauuguagacgaauggucauauacgggaucuuccuuuuaugcuccugaaccaauuacuucauuaaauacuaaauacguagcaccacaagugacauaucaaaacauaucuacuaacuugccuccaccucuacuagguaacucuaccggcaucgacuuucaagacgaacuagacgaguucuuuaaaaauguuucaaccucuauucccaauuucggcucacuaacucaaauaaauaccacacuucuagaucuuacuuacgaaaugcuaucacugcaacaaguaguuaaagcacugaaugaaagcuacauagaucuaaaagaauuaggcaauuacacauauuacaacaaauggccaugguacauuuggcuaggcuucauagcuggauuaguugcucuagcacugugcguauucuuuauauuaugcuguacagguugcggaacaaauuguaugggaaaauuaaaauguaaccgaugcugugauagauaugaagaauaugaucuagaaccucauaaaguacacguucacuaa

SEQ ID NO: 1110 - RNA, 4062 nt, Artificial Sequence
  derived and/or modified CDS sequence (opt6) from MERS-CoV__ALJ54468__S
augauccacucaguuuucuuacuaauguuucuuuuaacccccaccgaaucauacguggacguaggcccugauucuguaaaauccgcauguauagaaguagauauccaacagacguucuuugauaaaacauggccccgaccuauagacguuucaaaggccgauggaauaauauacccacaaggaaggacauauuccaauauaaccauaaccuaccaaggucuauuuccauaucagggcgaucacggugacauguacguauacucugccggacacgcaaccgguacuacaccacaaaaauuguuuguagcaaauuauagucaagauguuaaacaauucgcgaacgguuucgucguuagaauaggagcagcugcaaauucaacgggaacuguaaucauaucuccaucaacuucugcgacuauacgaaagauauacccagccuucauguuagguucaucaguaggcaacuucucugauggaaaaaugggacgcuuuuucaaucacacacuugugcugcucccugacggcugcggcacacuacuccgcgcauuuuacuguauacuugaacccagaucagguaaucauugccccgcaggaaauucuuauacaucuuuugcaacuuaccauacuccugcaaccgauugcagcgauggaaauuauaaucguaacgcaucauuaaacaguuuuaaagaauauuucaauuuaagaaacuguaccuucauguacacauacaauauaacagaagacgaaauucucgaaugguuuggaauaacacaaacugcucaaggaguacaccucuuuuccucucguuacguggaucuauauggcggaaacauguuucaauucgccacucucccaguuuaugauacaauaaaauacuauucaauaauaccccauucaaucagaaguauucaaucagaucguaaagcaugggcagccuucuacguauacaaacuacaaccauuaacauucuuauuagacuucucaguagacggauacauaagacgugcaaucgacugcgguuucaaugaucuuucacaauuacauugcuccuacgaaucauucgacguugaaucagguguauauaguguaucaucauuugaggcgaaacccucugggagcguagucgaacaagcagaagggguagaaugugauuucucaccacuauuaucaggaacaccuccucaaguuuacaauuucaaacgauuagucuucacuaauugcaauuauaauuuaacaaaauuauuauccuuauucuccguaaaugacuuuauaugcucccaaaucucuccagcugcaauagccucaaacuguuauaguucauuaauucucgacuacuuuucauacccucugagcaugaaaucagaucuuucaguuaguagcgcgggccccauaucacaauuuaauuacaaacagagcuucucaaauccgaccuguuugauccuagccacuguuccucauaaucuaacaacaaucacuaaaccucucaaauacuccuacauuaacaaauguuccaggcuacuuucagaugaccgaacugaaguaccacaacugguaaacgcaaaccaauacucaccaugcguaucaauuguaccaucaaccguuugggaggauggugacuauuaccguaaacaacuuucaccuuuagaggguggcggauggcuaguagcauccggaucaacaguugccaugacagaacaacuccaaaugggauuuggaauaacaguacaauauggcaccgauacuaauuccguaugcccaaaauuggaauuugcaaacgacacaaaaauagcuucacaacuuggaaauugcgucgaauauucacuuuacgguguaucuggacgagguguauuucaaaauugcaccgcagucggugugcgacaacaaagauuuguauacgaugccuaucaaaaccugguagguuauuauucagaugacggaaacuauuacugucucagagcaugcguuucggucccugucucaguuauauacgacaaagaaaccaaaacucaugcuacccuauucggaucuguagccugugaacauauuucauccacgaugucccaguacucucgcucuacaagaucuaugcucaaacguagagauucuacuuauggacccuuacaaacuccaguuggaugugucuuaggucucgugaacagcagucuauucguagaagacugcaaacuaccacuuggccaaagccuuugcgcauuaccagauacaccuuccacgcucacaccaagauccguaagaucaguaccuggcgaaaugagacuagccagcauugcauucaaccaucccauucaaguugaccaauuaaauagcuccuacuucaaguuaagcauaccaacuaauuuuucauuuggaguaacacaagaauacauccaaacaacaauccaaaaagucacuguagacuguaaacaauacgucugcaauggauuccaaaaaugcgaacaacuacuuagagaauacggccaauucugcuccaaaauuaaccaagcacuacauggagcaaaccuuagacaagacgacucugucagaaaucuauucgcaucgguaaaaucuucccaaucuuccccaauuaucccuggauuuggaggugauuuuaaucuaacuuuacuugagccaguaucaauaucaaccggaucaagauccgcuagaucugccauugaagaucucuuauuugacaaaguaacaauugccgauccaggauacaugcaaggguaugaugacuguaugcaacaaggaccagcuucagcaagggauuuaauuugugcacaauauguagcuggcuacaaaguacuucccccucucauggacguaaacauggaagccgccuauacaucaucauuacugggaucgauagcagggguaggauggacugcuggcuuaucaucuuucgcagcaauccccuucgcacaaucgauauucuaccgauuaaacgggguaggaauaacacaacaaguuuuaucagaaaaucaaaaguuaauagcuaauaaauucaaucaagcucuaggagcuaugcaaacaggcuucaccaccaccaaugaagcauucagaaaaguacaagaugccgugaauaauaaugcacaagcccuuucuaaauuagcaucagaacucucuaacacauuuggagcuauaucugcuuccauaggagauauaauacaaagguuagauguauuagaacaagaugcucagaucgaccgacuaauuaauggacguuuaacuacguuaaaugcuuucgucgcccagcaauuaguacguucugagucagcggcacuuucagcucaacucgcuaaagauaaaguaaaugaauguguaaaagcacaaucaaagcgauccggauucugcggucaaggaacacacauuguaucauucguaguuaacgcuccuaauggacuauacuuuaugcaugucgguuacuacccaucaaaucauauagaaguaguaagcgcuuauggccucugugaugcugcaaauccaacuaacugcauugcccccguaaauggguacuuuauuaaaacaaauaauacccguaucguagacgaauggaguuauaccggaucauccuuuuaugcaccagaaccaauaacaagccuuaacaccaaauacgucgcaccgcaaguaacguaccaaaacauuucaacaaauuuaccucccccauuacuagguaauucaacgggcaucgauuuucaagacgaacucgaugaauuuuucaaaaacguaucgaccuccauucccaauuucggaucuuuaacccaaauaaacacaacauuauuggauuuaacauacgaaauguuaucgcuacaacaagucguaaaagccuuaaaugaguccuacauagaucuaaaagaacucggcaauuacacuuauuacaacaaauggccaugguacaucuggcucggcuuuauagcaggccuaguagcguuagcacuaugcguauucuucauacucuguugcacagguugcgguacuaauuguaugggaaaacuaaaauguaaucgaugcugcgauagauacgaagaauacgaucucgagccccacaaaguucauguacacuaa

SEQ ID NO: 1111 - RNA, 4062 nt, Artificial Sequence
  derived and/or modified CDS sequence (opt6) from MERS-CoV__ALJ54471__S
augauacauucuguauaucuacuaauguuccuuuuaacaccaaccgaauccuauguagaugucggccccgacucaguaaaaagcgcgugcauagaaguagauauacaacaaacuuucuuugauaaaacuuggccaaggccuaucgacguaaguaaagcagaugguaucauauauccacaaggacgaacuuauucaaauauaacgauaaccuaucagggccuauucccauaccaaggugaucauggagauauguauguuuauucagcgggacacgcuacuggcacuaccccucaaaaacuuuucgucgcaaauuauucccaagaugugaaacaauucgcuaacggauuuguuguucgaauaggugcugcugcaaacuccaccggaacaguaauuauauccccaagcacuucagcuaccauaagaaagauauacccugcauuuaugcuagguucaucaguugguaauuucagcgauggaaaaaugggaagauucuuuaaucacacucuuguccuucucccagauggauguggaacucuccuaagagccuuuuauuguauacucgaaccaagaaguggaaaucauugcccagcaggaaauucguacacaucuuucgcaacuuaccacacuccugcuacagauuguucugauggaaauuauaaccgaaaugcaucccuuaacucauuuaaagaauauuucaauuuaaggaauuguacauucauguacacguauaacauaacagaagacgaaauucuagaaugguucggcauuacucaaacugcacaaggaguacauuuauuuucaagcagauauguagaucuauaugguggaaacauguuccaauucgccaccuuaccagucuacgauacaauaaaauauuacuccauuauaccacacagcauaagaucaauucaaucugaccgaaaagccugggcugcauuuuacgucuauaaacuacaaccacuaacuuuccucuuggauuucucgguugacggauauauaagacgagccauugauuguggauucaaugaccugucccaauuacauuguucguaugaaucauucgauguggaaagugguguauacucaguuucuagcuuugaagcuaaaccuucaggaucaguuguagaacaagccgaggguguugaaugcgauuuuucaccccuacuauccggaacaccaccucagguauauaauuuuaaacguuugguauuuacaaauuguaacuacaaccucacaaaacuucuaucacuauucuccguuaacgacuuuacuugcucacaaauaucaccagccgcaauagcaucaaacugcuauuccucacuuauacuggauuacuucucuuauccuuuaucaaugaaaucugaucuaaguguuuccucagcuggacccauuagucaauucaauuacaaacagucuuuuaguaacccaacaugucuuaucuuagcuacaguuccccauaaucugaccacaauaaccaaaccccuuaaauacaguuauauuaauaaauguucccguuuacucucagacgaucguacagaaguaccucaacucgucaaugcuaaucaauauucuccuuguguauccauuguacccucuacaguaugggaagacggagauuauuaccgcaaacaguuaucuccauuagaaggagguggaugguuagucgcgaguggaagcacagucgcuaugaccgaacaacuacaaaugggcuucggcauaaccguucaauacgggacggauaccaacuccguuugcccuaaacucgaauuugcaaaugacacaaaaaucgccagccaacucgggaauugcgucgaauauagucuauauggcguuucaggacguggcguauuucaaaacugcacagcagugggaguccgccaacaaagauuuguauacgaugcauaucaaaauuuggugggauacuacucagaugacgggaacuauuacugucucagggcuuguguaucggucccuguaucuguuaucuaugauaaagaaaccaaaacacacgcaacuuuauucggaucugucgccugugagcacaucucaucgaccaugucacaauacagucgaucgacucguuccauguuaaaaagaagagauuccacuuacggcccacuacaaacaccagucggaugcguucucggccuugucaacuccucccuauuuguugaagacuguaaacuuccacuaggucaaucauuaugugcuuuaccugauacaccuaguacuuugacaccccguucaguacguuccgugccaggcgaaaugagacuugcuagcauagcauucaaccaucccauucaaguugaccaacucaacaguuccuauuuuaaauuauccauuccaacaaacuuuaguuuuggaguuacucaagaauacauacaaaccacuauacaaaaagucacaguugacuguaagcaguauguauguaauggcuuccaaaaaugcgaacaauuacugcgagaauauggacaauucuguagcaaaauuaaccaagccuuacauggagcaaauuuaagacaagacgacaguguuagaaaucuauuugcaucagucaaaucgucacaauccucuccaauuauaccgggauuuggaggagauuucaauuuaacacuacuagaaccaguaaguauuaguacugguucaagaucugcccgaucagcgauagaagaccuacuauuugauaaaguaacaauagcugauccaggcuacaugcaaggcuaugaugacugcaugcaacaaggaccagcauccgcaagagaccugauaugugcccaauacguagcaggauauaaaguacucccacccuuaauggaugugaacauggaagcagcauauacaucaucauuauuagguucaauagcaggaguaggauggacagcuggcuuauccucauucgcugccauuccauuugcacaaagcauauucuaccgucuuaacggcguugggauaacgcagcagguacucucagagaaccaaaaauuaauagcuaacaaauucaaucaagcucuuggugccaugcaaacagguuuuacaacuacaaaugaagcauuucguaaaguucaggaugccgucaauaauaacgcacaagcauuauccaaauuagcauccgaacuaucaaauacuuuuggugcuauaagcgcuaguauaggagauauaauacaaagacuugauguuuuagaacaagaugcacagauugacagacuuauaaaugguagacuuacuacauuaaacgccuucgucgcucaacagcuuguaagaagugaaucagcagcccuaagugcccaacuagcaaaagauaaaguaaacgaauguguaaaagcucaaagcaaaagaucugguuucuguggacaagguacacauaucguguccuuuguaguaaaugcaccgaacggauuauauuucaugcauguggguuacuauccaagcaaucauaucgaaguaguuucagcauacggcuuaugcgaugcagcaaacccgacuaacugcauugcaccagucaauggguacuuuauaaaaaccaacaauacacgaauaguggaugaauggucauauacuggcuccuccuucuaugcuccagagccaaucaccucauuaaauaccaaguauguagcaccucagguuacauaccaaaacauaucaacaaauuuaccuccaccucuacucggaaauucaacagggauagauuuucaagacgagcuugacgaauuuuucaaaaacguaucaacaucaauccccaauuuuggaucacuuacucauauuaauacaacauuacuugauuuaacuuaugaaaugcucucacuccaacaagucguaaaagcacuaaacgaaucauacaucgauuuaaaggaacuugggaacuacacuuauuacaacaaauggccaugguauauauggcuaggauuuauagcuggacuuguggcucuagcauuaugcgucuuuuucauucuauguuguaccgguugcggaacaaauugcauggguaaauuaaaauguaauagauguugcgaccgcuaugaagaauacgaucuagaaccacacaaaguucauguacacuga

SEQ ID NO: 1112 - RNA, 4062 nt, Artificial Sequence
  derived and/or modified CDS sequence (opt6) from MERS-CoV__ALJ54472__S
augauacauagcguuuuucuauuaauguuucuccucacuccaacagaauccuaugucgacguagguccagauaguguaaagucagcauguauagaaguagauauacaacaaacauucuuugauaaaacauggccccgacccauagacguaucgaaggcugaugguauaauuuauccacaaggucgaacauacucaaacauuacuauaacuuaucaagguuuauuccccuaucaaggagaucauggugacauguauguauauagcgcaggccacgcuacuggaacaacaccccaaaaacuauucguagcuaacuacucucaagacguaaagcaauucgcaaauggauucguaguuagaaucggagccgcagcuaauucaacagguacuguaaucauuuccccuaguaccucggcaacgauuagaaaaaucuaucccgcguuuaugcuagguucaagcgucggaaacuucagcgacggaaaaaugggucgauucuuuaaccacacgcuaguacucuuaccagauggauguggaacauuauuaagagcguuuuacugcauacuagaaccacgcagcggaaaccauuguccggcaggaaauucauauacaucauuugccacauaccauacccccgcaaccgauugcucagauggaaauuauaaucgcaaugcaucacuuaacaguuuuaaggaauauuuuaaccuaagaaacuguacuuuuauguacacauauaauauuacagaagaugaaauucucgaaugguuuggcauaacacaaacugcucaagguguacaccuauuuucaucucgauacguagaccucuacggugguaauauguuccaauuugcaacguuacccguuuaugauacaaucaaauacuauucaaucauaccccacuccaucagaucaauacaaucugacagaaaggcaugggcggcauucuaugucuacaaacuccaaccacuuacauuucuacucgacuucucaguugauggauauauuagacgagccauagacugugguuucaacgacuuaucucaacuacacugcucauaugagagcuuugacguggaaucaggaguuuacucaguaucaaguuuugaagcgaaaccuucaggguccguaguagaacaagcagaaggaguugaaugcgauuuuuccccacuucugucaggaacaccuccccaaguauacaauuucaaaagauuaguuuuuacaaauugcaauuauaaucuaacaaaauuacucucucuauuuucgguaaacgacuuuaccuguucgcaaauaucucccgcugcgauagcgaguaauugcuauuccaguuuaauucuugauuacuucucauaccccuuaucuaugaaaucugaccucucaguauccagugcaggaccaauuucucaauucaacuauaaacaaucuuuuaguaaucccacaugucucauacuugcaacaguaccacacaauuuaacaaccauuacuaaaccauuaaaauauucauacauaaauaaaugcucccgacuacuaucagaugacagaaccgaggucccccagcuaguuaacgcaaaccaauauaguccuuguguaagcauaguaccuuccacaguaugggaggauggcgauuauuaucgaaaacaacuaucuccccuugaaggcggcgguuggcuuguagcaucagguucaacugucgcaaugacugaacaauuacaaaugggcuucggaaucacaguccaauacggcacagauacuaacuccguaugccccaaacuugaauuugcaaacgauacgaaaaucgcuucucaacuaggaaauugcguagaauacucccuguacgguguaucuggaagaggaguauuucaaaacuguacagccguagguguauuacaacaaagauuuguauaugaugccuaccaaaaccugguaggauauuauucagaugaugguaacuauuauugucuccgggccugcguaucagucccaguuuccguaauuuacgacaaagaaacuaaaacgcaugcaacacuuuucgggucaguagcaugugaacacauaucuucuaccaugucucaauauuccagaucaacacgaucuaugcuaaaacgucgugacucgacuuauggaccacuacaaacaccaguuggcuguguucuaggacuuguuaauucaucuuuauucguagaagacugcaaauuaccucucggacaaucauuaugugcacucccugauacucccucuacccuagcuccccgaaguguuagauccguaccaggagaaaugagacucgcuaguauugcauuuaaccauccaauacaaguagaucaauuaaauucaaguuauuuuaaacuuuccauuccaacuaacuuuucauuuggugucacucaagaguauauccagacaacaauacaaaaagucacaguagauuguaaacaauauguaugcaacggcuuucaaaaaugugaacaauuauuacgagaauauggacaauuuugcaguaaaauuaaucaagcacuucacggagcaaaucuacgucaagacgauaguguuagaaaucuauucgcuagcgucaaaucaagucaaucaucuccgaucauuccgggauucggaggagauuucaacuuaacauuauuggagccaguuucaauuucaaccggcucucguagugcacgaucugcgauagaagaucuucuuuuugacaaaguuacuauagcugauccaggcuacaugcaaggauaugaugacuguaugcaacaaggaccugcaucagcucgagaucuuauaugugcucaauacguggcugguuacaaaguacucccaccuuuaauggaugucaauauggaagcagcuuauacaucuuccuuauuaggcucaaucgcugguguaggauggacugcgggccucagcucuuuugccgcaauaccuuuugcacaauccauauucuacagauuaaauggugucggaauaacucaacaagugcucagcgaaaaccaaaaacuaauugcaaauaaauuuaaucaggcacuuggagcuaugcaaacaggauuuacaaccaccaacgaggcuuuucgaaaaguacaagaugcagucaauaauaaugcucaagcauuaagcaaacuugcaucagaacuaucaaauacauucggugcaauaucagcguccauaggcgauauaauccaaagacuugauguacucgaacaagaugcgcaaaucgacagauuaauaaauggacggcuaacgacacuuaaugcauucgucucacaacagcuaguccggucagaaucugcggcucuaagugcacaauuagccaaagacaaagugaaugaaugcguaaaagcacaaucaaaaagaucuggcuucugcggccaaggaacacauauaguuucauuuguuguuaacgcucccaacggccucuacuuuaugcauguuggauacuauccauccaaucacauugaaguaguaucugcauauggacuuugcgacgccgccaauccuacaaacuguauagcaccagucaacgguuauuucauaaaaacuaauaauacccgaauaguugacgaauggucauauaccggaucaucauucuacgcacccgaaccuauaaccagcuuaaauacaaaauauguugcuccucaaguaacuuaucaaaauauaucuacaaauuuacccccuccacuuuuaggaaacuccaccggcauagacuuccaagaugaauuagaugaguucuuuaaaaacguaaguacaucaauuccaaauuuuggaucauuaacucaaaucaacacaacuuuacucgacuuaacauacgaaauguuaagccuacagcaaguaguaaaagcguuaaaugaaucauacauagauuugaaagaauuaggaaauuauacauacuacaauaaauggccaugguauauauggcucggauucauugcagguuuaguugcgcuagcacuauguguauucuuuauuuuaugcuguacagguugcggaaccaacuguaugggcaaauuaaaauguaaucgcuguugugaccguuaugaagaauaugacuuagaaccucauaaaguacacguccacuaa

SEQ ID NO: 1113 - RNA, 4062 nt, Artificial Sequence
  derived and/or modified CDS sequence (opt6) from MERS-CoV__ALJ54474__S
augauucauucaguauuuuuauuaauguuucuucuuacaccaacugaauccuacgucgauguaggaccagacucgguaaaaucagccugcaucgaaguagacauacaacaaaccuucuuugauaaaacuuggccacggcccauagauguaucuaaagcagaugguauaauuuauccacaaggaagaacauacaguaauaucaccaucacauaucaaggucuauuuccuuaucaaggagaucauggugacauguauguuuacucagcuggccaugcaacaggaacaacgccacaaaaacuauucguugcuaacuauucacaagaugucaaacaauuugcaaacgguuucguaguucguauaggcgcugcugcuaacaguaccggaaccgugauaauaagccccucuaccucagcaacaauaagaaagauauauccagcauucaugcuuggaagcuccguuggaaauuuuucggaugggaaaaugggacguuucuuuaaucacacacucguucuauuacccgacggauguggcacauuacuacgcgcauuuuacugcauucuugaaccaagaagugguaaucacugcccagccggcaacucuuacacuucauuugcuacauaucauacucccucaacugauuguagcgacgguaauuauaauagaaacgccucacucaauucuuucaaagaauauuucaaucuaagaaauuguacuuucauguauacauacaacauaacagaagacgaaauacuagaaugguucgggauaacacaaacagcacaagguguacaucuauuuaguucacgcuauguagaccuauauggcggcaauauguuccaauuugcaacacuuccaguuuacgacacuauuaaauauuauucuauaauuccacauucaauacgaucgauacaauccgauaggaaagcaugggcugcuuucuacguauauaaacuucaaccccucacauuccucuuagauuuuucaguugauggauacauucgucgcgcgauugacugugguuuuaaugauuuaagucaauuacauugcucauacgagagcuuugacguagaaucugguguauacucaguuagcucauuugaagcaaaaccauccggaucugucguugaacaagccgaaggaguagaaugcgauuuuucaccauuauuaucagguacaccaccacagguuuauaacuuuaaacgauuaguauuuacuaacuguaacuacaauuuaacuaaacuccuuagcuuauuuuccguaaacgacuuuacgugcucacaaauaucgcccgccgcuauugcuucaaacuguuacagcagccuaauauuagauuauuuuucauauccauuaaguaugaagucagacuuaucaguuuccagugcaggacccauaagccaauuuaauuacaagcaaucauucuccaauccgaccugucuuauccuugcaacaguuccacauaaccuaaccacaauaaccaaaccccuuaaauacucuuauaucaacaaauguucacgacuacuaucagaugacagaacugaaguaccucaauuaguuaaugcaaaccaguauuccccaugugucucaaucgucccaucaaccguuugggaggacggcgauuauuacagaaaacagcuuucacccuuagaaggugguggauggcuaguagcaucaggaucaacugucgcaaugacagaacaacuccaaaugggauuugguaucacaguacaauacgguacugauacaaauucuguuugccccaaacuagaauuugcaaaugacacuaaaauagcaucccaauugggcaauugcgucgaauauucauuguauggugucuccggacgaggaguauuucaaaauuguacagcagucgggguacgccaacaaagguucguuuacgaugccuaccaaaauuuaguaggcuacuacucagacgacggaaauuauuacugucuuagagccugcgucuccguaccuguaaguguuauauacgauaaagaaacuaaaacacacgccacacuauuuggaucagucgcaugcgaacauauaucaucgacuaugucucaauauucaagguccacacggucaauguuaaaacgacgggauuccacguauggacccuuacaaaccccaguagguugcguacucggacucguaaacaguucucucuucgucgaagauugcaaauuaccauuaggacaauccuuaugugcacuccccgauacuccuuccacuuuaacuccaagaucagucagaucuguuccaggagaaaugagacucgcauccauagcguucaaccaucccauacaaguagaucaauugaacuccucauauuuuaaguuaucaauuccuacaaauuuuaguuuuggaguuacacaagaauacauacaaacaacaauacaaaaagugacuguggacuguaagcaauacguuugcaacggauuucaaaaaugcgaacaauuauuacgcgaauacggccaauuuugcucaaaaaucaaucaagcucuacacggagcaaauuuacgacaagacgauucagucagaaauuuauuugcaucaguaaaaaguucacaaucaucgccaauaauuccuggauuuggaggugauuucaaucucacauuacuagaaccaguuaguauuuccacagguuccagaucagcaagaucagccauagaggaucuacuuuuugauaaaguaaccauagcugacccaggauacaugcaagguuacgaugauuguaugcaacaaggcccagccucagcucgagaucuuauaugcgcucaauaugucgcgggguauaaaguacuucccccucucauggaugucaauauggaagcagcauacacuuccucccuuuuaggaucuauagccggaguaggauggacugccggauuaucuuccuucgcagcuauccccuuugcgcaauccauauucuauaggcuaaacgguguaggaauaacacaacaaguucuuucugaaaaucaaaaacuaauagcgaauaaauucaaucaggcuuuaggagcaaugcaaacaggcuucaccacuaccaaugaggcauuucguaaaguucaagacgccgucaacaauaaugcacaagcccuuucaaaacucgccucggaguuaagcaauacauuuggugcaauuucugccucuauuggagauauaauacaacgacucgacguacucgaacaagaugcacaaaucgaucgauuaaucaacggacgacuuacuacacuaaaugcauuugucgcucaacaacuuguucgaucagaaagcgcagcauuaucggcccaacuugcaaaagacaaaguuaacgaaugugucaaagcccaaucuaaaagauccggguuuugcgggcaagguacucacauaguuucauuugucguuaacgcaccaaacggucucuauuuuaugcauguugguuauuaccccagcaaccacauugaaguagugagugcauauggucucugcgacgcagcuaauccuacaaacugcauugcucccguaaacggguauuuuauaaaaacuaacaacacacguguuguagaugaauggucuuauacagguucauccuuuuaugccccagaaccaauaaccucucuaaacaccaaauauguagcuccucaaguaacuuaucaaaauauuucuacuaaccuucccccuccccuacuuuccaauaguacggggauagauuuccaagaugaacuagaugaauuuuucaaaaacguaagcacaagcauaccuaacuuuggaucuuuaacucaaaucaacacuacgcucuuagacuuaacuuacgaaaugcuaucgcuacaacaaguaguaaaagcauuaaaugaguccuacauagaccucaaagaacuuggcaacuacacuuauuauaauaaauggccaugguacauaugguuagguuucauagcugguuuaguagcacuagcauuauguguguucuuuauccuauguuguacuggaugugggacaaacuguaugggaaaacuuaaaugcaauagauguugcgaucguuacgaagaauaugauuuagaaccccacaaaguacauguucacuaa

SEQ ID NO: 1114 - RNA, 4062 nt, Artificial Sequence
  derived and/or modified CDS sequence (opt6) from MERS-CoV__ALJ54483__S
augauccauagcguauuccuuuuaauguuccuauuaacuccuacugagucauauguugauguuggaccagacagugucaaaucugcauguaucgaaguagauauccaacaaacauucuucgacaaaacauggcccagaccuauagauguuucuaaggcagacggaauuaucuauccacaaggucgcacauacucaaauauaaccauuacguaucagggacuuuuuccauaccagggagaucauggagauauguauguguauucggcagggcacgccaccggaacaacaccacaaaaacuauuugucgcaaacuacucacaagaugucaaacaauucgcgaaugguuuuguaguuagaaucggagccgccgccaauucuacaggcaccguuauaaucucacccucaacuucugcuacuauacgcaaaauauauccagcauucaugcuaggaagcucaguaggaaauuucucagauggcaagaugggaagauucuucaaucauacccuaguucuacuuccagacggcugcgguacccuacuccgagcauuuuauuguauacuagaaccaagaagcggaaaucauuguccugcaggaaauucauacacuucauuugcaaccuaccauacaccagcgacagacugcucagauggaaauuacaauagaaaugcauccuuaaacucauuuaaagaauacuuuaauuuaagaaacugcacauucauguacacauacaacauaacagaagacgaaauccuagaaugguuuggaauaacccaaacugcacaaggcguacaucuauucucaucucguuauguagaccuauauggaggaaauauguuccaguucgcuacacuaccaguauaugauacuauaaaauauuacaguauaaucccccauucaauucgcucaauacaaucagaccgaaaagcgugggccgcguuuuaugucuacaaacuucaaccauuaacuuuucuuuuagauuucaguguagauggguauauacgucgcgcaauagauuguggauucaaugauuuaucacagcuucauuguaguuacgagucuuuugauguagagucagguguuuauagugucuccagcuucgaggcaaaaccaagcggauccgucguugaacaagcagaaggaguagaaugugauuuuucaccccuccucucagguacuccuccccaaguauauaacuucaaacgucuuguauucacaaacugcaacuacaaccuuacaaaacuauuaucucucuuuucagucaaugacuuuacauguucucagaucaguccagcagcuauugcuuccaauugcuauucaucccuaauuuuggauuacuuuaguuauccauuaucuaugaaaucagaucuuuccguuagcucagcuggaccgauauuucaauucaauuauaaacaguccuuuucaaauccuaccugccucauuuuggccacgguaccccauaaccuaacuaccauaacuaaaccauuaaaauacucauacauaaacaaaugcucccgcuuacuuagugacgacagaacugaaguuccgcaacugguaaacgcaaaucaauauucaccaugcguauccauaguuccaucaaccguaugggaagauggcgauuacuaccgaaagcaauuauccccauuagaaggcggugguugguuaguagcgucaggcucuaccguagccaugacagaacaacuacaaauggguuucgguaucaccguccaauacgguacagacacaaacucaguauguccaaaacuagaauuugccaaugacacuaaaauugccucucaauuaggaaacugugucgaauauuccuuauacggcguaaguggcagaggagucuuccaaaauuguacagccguugggguuagacaacaaagauuugucuaugacgccuaccagaaccuagucgguuauuauucagacgacgguaacuacuacugcuuacgagcaugcguuucaguaccagucuccguaauuuaugauaaagaaacuaaaacccaugcgacccuauuugguaguguagcaugcgaacauauaucuuccaccaugagccaauacucccgaucaacaagaucaaugcucaaaagaagagacucaaccuacggcccccuucaaacaccaguaggauguguauuagguuugguaaacucaucucucuucguugaagacugcaaacuuccauuaggacaaucacuaugcgccuuacccgacacucccucuacccucaccccuagaucaguacguuccgucccuggugaaaugagacuagcgaguauugccuuuaaccauccaauucaaguugaccaauuaaauaguucuuacuuuaaacuauccauuccuacuaacuuuaguuuuggaguuacacaggaauacauacaaacuacuauccaaaaaguaacuguugacuguaaacaauauguuuguaacggcuuccaaaaaugugaacaacuucuaagagaauauggucaauucuguucuaaaauaaaccaagcucuccacggagcgaauuugcgucaagacgacucaguaagaaaucuuuuugcaucaguaaaaagcagucaaucaucuccaaucauacccggcuuuggaggugacuucaaccuaacacuucuugaaccuguaaguauauccacuggaaguagaagugcacguuccgcaauagaagaucucuuauuugauaaagucacuauugccgauccuggauacaugcaagguuacgacgauuguaugcaacaagguccugcauccgcuagagauuuaauaugcgcccaauacgucgcgggauacaaaguauuaccaccguuaauggacguuaacauggaagcagcauacacuagcuccuuauuaggaucaauagcgggaguuggauggacagcuggauuaagcucuuuugcagccauuccauuugcacaaagcauauucuacagauuaaacggcgucggaauaacucagcaaguucuuucugaaaaucagaaacuuauagccaacaaguuuaaccaggcuuuaggcgcuaugcaaacaggauucacuacuaccaacgaagcauuccguaaaguucaagacgcuguaaauaauaaugcucaagcauuauccaaacuggcaucggaauuauccaauaccuucggagcaaucuccgcaagcaucggggauauaauucaaagacucgauguacuagaacaagaugcacaaauagaucgacuuauaaauggacguuuaaccacacuaaaugcauucguugcacaacaauuaguuagauccgaaagcgcugcacuaucugcucaacucgcaaaagauaagguaaaugaaugugucaaagcacaaucaaaaagaucaggauucugcggucaaggcacccauauuguaucuuuuguaguaaacgcacccaacggcuuauauuuuaugcauguaggauacuaccccucuaaccauaucgaaguagucagugcauaugguuuaugcgacgcugcaaaucccacuaauugcaucgcccccgucaacggguauuucaucaaaacaaacaauacucguauuguagacgaauggaguuacacagguucaucuuucuaugcaccagaaccaauaacaucauuaaacacaaaauacguagcuccccaaguuaccuaucaaaacauaaguacaaauuuaccaccuccauuacuugguaauucuaccggaauagacuuucaagaugaacuagacgaauuuuucaaaaacguaaguacauccauaccuaauuucgguucccuaacccaaaucaacacaacuuuauuagauuuaacauacgaaaugcucucgcuucaacaaguugucaaagccuuaaaugaaucauacauugauuugaaagaacuaggaaauuauacauauuacaacaaauggcccugguacaucuggcuaggauucauagcaggauuaguagcacuugcucuguguguauucuuuauacuauguuguacuggauguggaacaaauugcauggggaaauuaaaaugcaacagauguugcgacagauacgaagaauaugaucuagaaccacauaaaguccacguacacuga

SEQ ID NO: 1115 - RNA, 4062 nt, Artificial Sequence
  derived and/or modified CDS sequence (opt6) from MERS-CoV__ALJ54486__S
augauucauucugucuucuuacuuauguuucuacucaccccaaccgaaucauacguugacgucggaccugauagcguuaaaucagccuguauagaaguagauauacaacaaacauucuuugauaaaacuuggccccgaccaaucgauguaucaaaagcagauggcauaauauacccucaaggcaggacuuauucaaacauuacaauaacuuaccagggccuguuuccauaccaaggagaccacggagacauguacguuuauucugcgggccaugcaacuggcaccacaccccaaaaauuauuuguagcaaacuacagccaagauguuaaacaguucgcuaauggcuuuguaguacgaauaggagcagcagccaauuccacagguacaguaauaaucaguccaagcacaucagcaacaauacgcaaaauuuauccugcuuuuauguuaggcuccucaguuggaaacuuuagugacggcaaaaugggacgcuuuuucaaccacacccucguacuacuuccugauggaugcggaacuuuauuaagagcauucuauugcauuuuagaaccaaggagugguaaccacuguccagcgggaaauucauacacauccuuugccacauaccauacaccagcuacugauuguuccgacgggaauuauaaucgcuacgcaucacucaacucuuucaaagaauacuuuaauuuaaggaauugcacauuuauguauacauauaacauuacagaagacgaaauacuugagugguucggaauaacucaaaccgcgcaaggaguccaccuauuuuccagccgauacguagaccucuacgggggaaauauguuucaauucgcuacucuuccaguuuacgauacaauaaaauauuacucuauaaucccucacaguauucgaucaauucaaagcgaucgcaaagccugggcagcauuuuacgucuauaaauuacaaccacuaacguuucugcucgauuucucaguagauggauacauaagacgugcaaucgauuguggauucaaugacuugucacaacuucacugcucauaugaauccuucgacguagaaucagguguguauucuguaucaucauuugaagccaaaccuaguggaaguguugucgaacaagcugaagguguagaaugugauuuuucaccacuucuuucugguacaccaccacaaguauacaacuuuaagcgacuuguauucacuaauugcaacuauaacuuaacaaaacuccuaucauuauuuuccguaaaugacuucacauguucucaaauaagcccugccgccauagcaaguaacugcuacuccucacuaauccuagauuacuuuuccuauccauuauccaugaaaucugacuuaucuguuaguucugcagguccuauaucacaauucaauuauaaacaauccuucucaaauccaacgugcuuaauacuugccacugucccacacaaucuaaccaccauaacuaaaccauuaaaauacucuuauauaaauaaguguucucgccuacucuccgacgaucgaaccgaaguaccucaguuaguaaaugccaaucaauauaguccauguguauccauaguaccuucaacaguuugggaggauggagacuauuaucguaaacaauuaucuccccuagaagguggaggauggcuugucgucuccgguucuacugucgccaugacagaacaauuacaaaugggauucggaauuacuguacaauacggcacagauacuaacucaguaugucccaaacuagaauuugcaaacgacacuaaaauagcgagccaacucgggaauugcguagaauauucuuuauacggugucuccgguaggggcguauuucagaacuguacugcaguaggaguccgacaacaaagauuuguuuacgacgcauaccaaaaucucgucggauacuauagugacgacggaaauuacuacuguuuacgagcaugcguaucagugcccgucucuguuauauacgauaaagaaacuaaaacccacgcaacauuauuuggcucagucgcaugcgaacauauaucuucaaccaugucgcaauauucaagaucuacaagaucgauguuaaaacgaagagauagcacauacggcccacuucaaacaccgguugguugugucuuaggauuaguaaacuccucccuauuuguugaagauuguaaacuaccauuaggacaaagccuaugugcuuuaccagacacacccucaacauugacuccaagaaguguaagaagcgucccaggcgaaaugcgauuagcauccauugcuuuuaaucacccaauacagguagaucagcuuaacucuaguuauuucaaguuaucaaucccuaccaauuucaguuuuggagucacacaagaauacauucagacuaccauccaaaaagugacuguagauuguaagcaauacguauguaacgguuuucaaaaaugugaacaacuucuucgagaauacggucaauuuuguucaaaaauuaaucaagcacuacauggagcaaaucuacgacaagacgacucagugcgaaacuuauucgcaagcguaaagaguucccaaucauccccaauuauuccugguuucggcggcgauuuuaaccuuacacuacuagaaccuguaucaauuucgaccggaucacguagugccagaucagcaauagaagaccuuuuguucgauaaaguaacaauugcagacccaggauauaugcaaggcuaugacgacuguaugcaacaaggaccugcaagugccagagaccuaaucugcgcgcaauauguagcaggauacaaagugcuaccucccuuaauggaugucaacauggaagcugcauacacaaguucuuuauugggcuccauugcgggaguaggcuggaccgcaggauuaucaucuuucgcagcuaucccguuugcccagucaauauucuauagauuaaauggaguaggaauaacucaacaaguacuaucugaaaaccaaaaacuuaucgcaaacaaauucaaccaagcucuaggcgcaaugcagaccggauuuacaacaacaaaugaagcauuuagaaagguacaagacgcagucaacaauaacgcacaagcacuaucuaaacuagccagugaauuaucuaauacauucggcgcaauaucagcaaguauaggugauauaauucaacguuuagacguacuagaacaagacgcccaaauagaucgacuuaucaacggacgauuaacuacucuaaaugcauucguagcccaacaauuaguacggucagaaucagcugcauuaagugcacaacuggcuaaagauaagguaaaugaauguguaaaagcgcaaucuaaacgaucagguuuuuguggacagggaacacauaucguuucauucguuguaaaugcaccaaacggccuuuacuuuaugcaugucggauauuauccuucaaaccacauugagguugucucugccuacggcuuaugcgacgcugcaaauccaacuaauugcauugcaccagucaaugguuauuucauuaaaacuaauaauacucgaauaguggaugaauggagcuauacuggaucaaguuuuuaugcaccagaacccauuacaaguuuaaauacuaaauauguugcaccccaagucacuuaucaaaauaucaguacuaauuuaccaccaccacuucucucaaauucuaccggaauagacuuccaagaugaacucgaugaauuuuucaaaaacguaucaacauccauuccaaauuuuggauccuuaacgcaaauaaacacaacucuacuagacuuaaccuaugaaaugcuaucuuuacaacaagugguuaaagcccuaaaugaaagcuauaucgauuuaaaagaauugggaaauuauacauauuauaauaaauggcccugguauaucugguuaggauuuauugcuggauuggucgccuuagcucucuguguuuucuuuauucuaugcuguacuggaugcggaaccaacugcaugggcaaacuaaaaugcaacagaugcugcgauagauaugaagaguacgaucuagaaccacacaagguucauguacacuga

SEQ ID NO: 1116 - RNA, 4062 nt, Artificial Sequence
  derived and/or modified CDS sequence (opt6) from MERS-CoV__ALJ54488__S
augauucacucaguauuccuucuaauguuuuuauuaacucccaccgagaguuauguagacguuggaccugacucagucaaaucagcauguauagaaguugauauacaacaaacuuucuuugacaaaacauggccgaggccaauugauguaucuaaagcagacggcauaaucuauccacagggaagaacauacucuaauauuacaauuacuuaucaagguuuauuuccauaucaaggcgaccacggagacauauauguauauagcgcaggucacgccaccggcacaacaccacagaaauuauuugucgcgaauuauucacaggauguaaaacaauuugcaaauggauucguaguucguaucggugcugcggcgaacucaacaggaacaguaauuauuucacccaguacuagcgcuacgauacgaaaaauauauccggccuuuauguuagguucuucgguuggcaacuuuucagauggaaaaaugggacgcuucuucaaucacacuuuaguuuuauuaccagacggauguggaacacuauuacgagcauuuuauuguauacuugaaccacgaagcgguaaccauuguccagcaggaaauaguuacacgucuuuugcaacauaccacaccccugcgacagauuguucagacgguaauuauaacagaaacgcuucacuuaacucguuuaaagaauauuuuaaccuaagaaauugcacuuuuauguacacauauaacauaacugaagaugaaauauuagaaugguuuggaaucacucaaacagcccaaggcguucaccucuuuagcucccgauaugucgaccuauauggaggcaauauguuccaauuugcgacucuacccgucuaugauaccauaaaauauuauucaaucauuccgcacucaauacggucaauucaaagugauagaaaagcaugggcagcauucuauguauauaaauuacaaccucuuacauuucuacuagauuuuaguguugacggcuauauacguagagcuauugacugcggcuuuaaugacuuaucacaauuacacugcucauaugagucuuucgauguagaaagcggugucuauaguguauccuccuucgaagcuaaaccuagcggaaguguugucgaacaagcugaaggaguagaaugugacuuuucaccccugcucucaggcacaccaccccaaguuuauaacuuuaaaagauugguuuucacuaacugcaauuauaaccuaacaaaacuucuuucuuuauuuucaguaaaugauuuuacauguagucaaauuucaccagcagcaauugcaucuaauuguuacagcagcuuaauauuagauuauuuuaguuauccccuuucuaugaaaagugaucuuagcgucuccucugccggaccaauaucgcaauuuaauuacaaacaaucuuucucaaauccuacaugucucauucuugcuacugucccucacaauuuaacuacgaucacaaagccauuaaaauacucauacauaaacaaauguucaagauuacugucugacgacagaacugaaguaccccaacuuguaaaugcuaaucaauacucuccaugugucaguaucgucccaucuaccgucugggaagacggagacuauuauagaaaacaauuaucuccuuuagaaggagguggaugguugguagcaagcggaucaacagucgcaaugacagaacaauuacaaauggguuuuggaauuacaguccaauacggaacggauaccaauaguguuugucccaaauuagaauuugcaaaugauacuaagauagcuucucaguuaggcaauugcguagaauauucucuauauggagucagugguagaggaguuuuccaaaacuguacagcaguaggaguuagacaacagagauucgucuaugaugcuuaucagaauuuaguggguuauuacucagacgaugguaauuacuauugucuaagagcaugugucuccgugccugucucagucauauaugauaaagaaacaaaaacucaugcaacacuauucggaucugucgcaugcgaacauauuucauccacuaugucucaauacucacgaucaacccgcucuaugcuaaaaagaagagacucuacuuauggacccuuacaaacuccuguaggaugcguacucggucucguuaauuccucgcuauucguagaagauuguaaauuaccuuuaggacaaucucuuugugcauuaccagauacaccaucaacacuuacuccucguagcguucgcagcgucccaggugaaaugcguuuagcaucaauagccuuuaaucacccaauacaaguagaucaacucaauagcucuuauuucaaauuaaguaucccuacaaauuucucuuucggagucacacaagaauacauucaaaccacaauacaaaaaguuacaguugacuguaaacaguacguuuguaacggauuccaaaaaugugaacaauuauuaagagaauauggacaauucugcuccaagauuaaccaagccuuacauggugcaaaccuaagacaagaugacuccguaagaaaccucuucgcuucaguaaaauccucccaauccucaccaauaauaccaggauuuggaggugauuuuaacuuaacacuccuagaaccaguaucuaucucaaccgggucacgcagcgcaagaucagccauugaagacuuguuauucgauaaaguuaccauugcagacccaggauacaugcaaggauaugaugauuguaugcaacaagguccagcaagugcccgagaucuuaucugugcucaauacguugcagguuauaaaguacucccgccacucauggacguaaacauggaagcagcauauacaucgucauuauuagguucaauagcagggguugguuggacugcuggucucucuucauuugccgcuauaccauucgcacaaaguauuuucuaucggcuuaauggaguagggauaacacaacaaguauuaagcgaaaaccaaaaauuaauagcuaacaaauucaaucaagcauuaggcgccaugcaaaccggcuucacuacuacaaaugaagcauuuagaaaaguccaagacgcuguuaacaauaaugcucaagccuuaucaaaacuugcaagugaacuaucuaauacauucggagcaauaucugcaucaauaggagauauuauacaaagauuagacgucuuagaacaagaugcacaaaucgaucgacuuauaaauggaagacugaccacacuaaacgccuuugucgcccaacaauuaguacgaucagaaucagcagccuuaagcgcacaauuggcuaaagauaaaguaaacgaauguguaaaagcucaaucaaagcgcucaggauuuugcgggcaaggcacccacaucguaucuuuuguaguaaacgcuccaaacggucuauacuuuaugcauguaggauauuacccaucuaaucacauugaagugguauccgcauaugguuuaugugaugccgcuaauccgacaaacuguauagccccagugaauggcuacuuuauaaaaacaaauaacacucgcauaguugacgaaugguccuauacuggauccucuuuuuacgccccugaaccaauaacuucacuaaauacuaaauacguugccccacaaguuacguaccaaaauauauccacaaaucuacccccacccuuauuagguaauaguacaggcauagauuuccaagacgaacuagaugaguucuuuaaaaacguaucuacuucaauacccaacuucgguagucuaacucaaauuaacacaacgcuuuuagaucuuacauaugaaauguuaagccuucaacaaguagucaaagccuuaaacgaaucauauaucgaccuaaaagaacuaggaaauuacaccuauuauaauaaauggcccugguacauauggcuaggcuucauagcaggucuuguagcuuuagcauuauguguauuuuucauucuaugcugcacuggaugcggaacaaacuguaugggaaagcuaaaaugcaaucguugcugugauagauacgaagaauaugacuuagaaccucauaaaguucacguacauuaa

SEQ ID NO: 1117 - RNA, 4062 nt, Artificial Sequence
  derived and/or modified CDS sequence (opt6) from MERS-CoV__ALJ54490__S
augauccauucuguguuuuuacuaauguucuuguuaacaccaacagagagcuauguagauguugguccggauucagucaaauccgcuuguauagcaguagauauccaacaaacauucuuugacaaaacauggccucgcccuauugauguaucuaaagccgacggaauaauauauccacaaggacguaccuacucaaauauaacaaucacuuaucagggacuauuuccauaucaaggcgaucauggagauauguacguguauucagcaggccaugccacagguacaacaccacaaaaacuuuuuguagcaaacuacagucaggauguuaaacaguuugccaaugguuuugucguucgaauaggagccgcugcaaauucaacagguacgguuauaaucagcccaucaacgucagccacaaucagaaaaaucuauccagcguucauguuaggaucuagcgucggaaacuuuagcgauggaaagaugggucgauucuuuaaucacacucuaguauuacuucccgauggguguggcacauuacuacgagcuuucuacuguauucucgaacccagauccgguaaccauugcccagcagguaacaguuauacaaguuucgcaacauaccauacacccgcuacagacuguucagauggcaacuauaaucgaaacgcuucccuaaacucauucaaagaauauuuuaacuuaagaaauuguacuuucauguacacauacaacaucacagaagacgaaauuuuagaaugguucggaaucacacaaacugcacaaggaguacacuuauuuagcucaagauacguagaucucuauggugggaacauguuucaauuugcaacacuacccguauaugacacaauuaaauauuauaguauaauaccacauaguauacguucaauacaaucagacagaaaggcaugggccgcuuucuauguauauaaacuacaaccucuaacauucuuacuagauuucucuguugacggauauauuagacgugccaucgauugcggauucaaugaccuaucucaguuacauugcaguuacgaguccuuugacguugaaucaggcguauauucugucucauccuuugaagcuaaaccauccggaagcguaguugaacaagcagaagguguugaaugcgauuuuuccccuuuacuuagcggaacaccuccccaagucuacaauuucaaacgucucgucuuuacaaacugcaauuacaaucuuacaaaauuacuaucacuauucucaguaaaugauuucacaugcagccaaauaucaccagcagccauugcaucaaacugcuauucgucgcuaauauuagacuauuucucguaccccuuaucuaugaaaagugaucuaaguguaagcucagcagguccgauuucccaauucaauuauaaacaaucuuuuuccaaucccacuugccuuauacuagcaacaguuccgcauaacuuaacuaccauuacaaaaccccucaaauacucauauauaaacaaauguucacgacuccuaagugauggccgcacugaaguuccacaacucgucaacgcaaaucaguauuccccauguguaucaauagugccuuccaccguaugggaagauggagacuacuaucgcaaacaauuauccccuuuagaagguggaggaugguuagucgcgucgggcuccacugucgcaaugacagaacaauuacaaaugggauucggaauaacuguacaauacggaacagauacgaacucuguaugcccuaaauuagaauuugccaacgacacaaaaauagcaucucaacuuggaaauugugucgaauauuccuuauauggcgucuccggacgcggcguuuuucaaaacugcacagcagucggaguuagacaacaacgcuuuguauacgacgccuaccaaaacuuagucggcuacuacucugacgacggaaacuacuauuguuuaagagccugugucagcgucccagucucaguaauauacgauaaagaaacaaaaacacaugccacccucuucggaucaguugcgugcgaacacauuucaucuacaaugucacaauacaguagaucaacacgaucuaugcucaaacguagagauagcacauauggaccuuuacaaacaccuguaggcuguguacuuggccugguaaacucaucacuauuugucgaagacuguaaauuaccacuuggucaaucccuuugcgcuuuacccgacacaccaucaacucuaaaaccacgcaguguaagaaguguuccuggcgaaaugcgcuuagcaucuaucgcauuuaaucauccaauucaaguugaccagcuaaacucaucuuacuucaaacucagcauaccaaccaauuucucguuugguguuacucaagaauacauccaaacaacaauccaaaaaguaacuguugauuguaaacaguacguauguaauggcuuucaaaaaugugaacaacuccuucgagaauauggacaguuuuguucaaaaaucaaucaagcacuucacggagcaaacuuacgacaagaugacaguguaagaaaccuauuugcaucuguaaaaucaagccaaaguagucccaucauaccaggauuugguggagacuucaaucuaacucuacuagaaccuguauccauaucaacaggaucacguucagcucgaucugcaauagaagaucuauuauuugauaaaguaacaauagcagaucccgguuacaugcaagguuaugaugacugcaugcaacaaggaccugcaucugcacgcgaucuaauaugcgcccaauacguagcuggauauaaaguucuaccuccauuaauggauguuaauauggaagcugcuuauacauccagccuacuuggcucuauugcuggagucggcuggacugcaggcuuaucaucauuugcagcaauaccuuucgcacagucaaucuucuacagacucaaugguguaggcauuacucaacaaguuuuaucagaaaaucaaaaacucauagcuaauaaguucaaccaagcacuuggugccaugcaaacuggauuuacuacuacaaacgaagcauuuagaaaaguucaagacgcaguuaacaauaaugcucaagcucuaucaaaauuagcaucagaacuuucuaauaccuucggugcaauaagugccaguaucggugacaucauacagagauuagacguucucgaacaagaugcccaaauugauagauuaauaaauggacgauuaacuaccuuaaacgcauucguagcccaacaauuaguaagaucagaaucagcugcauuaucagcucaacuggcaaaagauaaagucaacgaauguguuaaagcacaauccaaaagaucaggauucuguggacaagggacacacauuguuucauucgucguaaaugcaccuaacgggcuguacuucaugcacgucggauacuacccauccaaucacauugaaguaguaucagccuaugguuuaugcgacgcagcaaauccuacuaacuguauugcaccaguuaauggauauuuuauuaaaacaaacaacacaagaaucguagacgaauggaguuacacaggcucaaguuucuacgcacccgaaccaauaaccucccuaaacaccaaauauguagcaccgcaagucacauaccaaaauauuucaacaaauuuaccuccuccgcuacuagguaacucaaccggcauagacuuccaagaugaauuagacgaauuuuucaaaaacguaagcacauccauaccaaauuucgguaguuuaacacaaaucaauacaacauuacuagaccuaacauaugaaaugcuuucuuuacaacagguagucaaagccuugaacgaguccuacaucgaccuuaaagaacuagggaacuacacauauuacaacaaauggccuugguacauauggcuaggauucauugcuggauuaguggcacuagcacuaugcguuuucuuuauucuaugcuguacaggauguggaaccaauuguauggggaaacuuaaaugcaaucgaugcugugaucgauaugaagaauacgaucuugaaccacauaaaguacacguacauuaa

SEQ ID NO: 1118 - RNA, 4062 nt, Artificial Sequence
  derived and/or modified CDS sequence (opt6) from MERS-CoV__ALJ54495__S
augauucauucuguuuuucuuuugauguuucuccuuacaccaacagaaaguuauguagacguaggcccagacaguguaaaaagugccuguaucgaaguagauauacaacaaacauucuuugacaaaacuuggccgagaccaauagacguaaguaaagccgacggcauaauauacccucaaggacgcaccuauucuaauauaacaauaaccuaccaaggauuauuuccauaucaaggcgaccacggugacauguacguauauuccgcaggccaugcaaccggcacuaccccacagaaacuauuuguugcuaauuauucacaagacguaaaacaauuugcaaacggguuuguagugagaauuggcgcugccgcuaauucaacaggaacaguaauaauaucaccaucuacaucugcaacuauacgaaaaauuuacccggcauuuaugcuaggaagcucugucgguaauuuuucugaugguaaaauggggagauuuuucaaucacacguugguucuucuaccagacggaugcggcaccuuacucagagcauuuuauugcauacucgaaccacgcucagggaaucacuguccugccggaaacucuuauacauccuucgcaacauaccacaccccugcuacugauugcucugacggaaauuacaaccgaaacgcauccuuaaauucuuuuaaagaauauuuuaaucuuagaaauugcacguucauguauacauacaauauuacagaagacgagauauuagagugguuugggaucacucaaacugcacaaggagugcacuuauuuucauccagauauguugauuuauacggagguaauauguuucaauuugccacacuaccagucuacgacacgauaaaauauuauuccauaauaccucauucaauucgaucaauccagucugauagaaaagcaugggcagccuucuauguauauaaacuacaaccacuuacauuccucuuagauuucucaguagauggcuauauacgucgcgcaauugauuguggcuuuaaugacuuaucucaacuucacugcucauacgagaguuucgauguugaaucggguguauauucgguuuccuccuuugaagcuaaaccuucagggucaguuguagaacaagcagaagguguagaaugugacuucucaccacuacuuucagggacucccccacaaguauacaauuucaaacgacuuguuuuuacaaauuguaauuauaaucuaacaaaauuacuuucuuuauuuaguguaaacgauuucacuuguagucaaauuaguccggccgcaauugcaucuaauugcuauucaucucucauucuggauuacuuuuccuacccauuaagcaugaaaucagauuuaaguguuagcagugcugguccaaucucccaauucaacuacaaacagagcuuuucaaauccuacauguuuaauauuagcuacuguaccacauaaucuuacaaccauaaccaaaccuuuaaaauacucuuauauaaacaaaugcaguagacuacuaucugacgacagaacugaaguuccacagcuaguaaacgcuaaccaauacucaccauguguaucuauagucccaucuacaguaugggaagauggugauuacuaccgcaaacaacuaucgccacucgaagguggagggugguuagucguuuccggaucuaccguagcaaugacugaacaacuucaaauggguuucggaauaacaguacaauacggaaccgacacuaacagcguauguccaaaauuagaguucgcuaaugacacaaaaauagccucucaacucggaaacuguguugaauauucucucuauggaguauccggacgaggaguauuucaaaacugcacagcuguaggaguacgccaacaaagguuuguguaugaugcauaccaaaacuuaguuggauacuauagcgaugacgguaauuacuauugcuuaagagcauguguaucagucccaguaucaguaauuuaugauaaagaaaccaagacgcaugccacacucuuuggauccguugcgugcgaacauauuuccucuaccaugucacaauauucacguucaacucguuccaugcuaaaacgcagagacucuacauacggaccauuacaaacaccaguuggaugcguccuaggucuuguaaauucuucucuauuugucgaagauuguaaauuaccuuuaggacaaucccuuugcgcucuaccagacacucccuccacucuuacaccccgaucaguaagaucaguaccaggcgaaaugcgacucgccucaauagcauucaaccaccccauucaaguagaucaacucaauucauccuauuucaaacucaguauacccaccaauuucucauuuggagucacgcaagaguauauacaaacuacaauacaaaaaguaaccguggacuguaaacaauaugucugcaacggauuucaaaaaugcgaacaacuucuuagagaguauggacaauucuguuccaagauaaaucaagcacuccauggggccaaucucagacaagaugauucaguacgaaaucucuucgcauccguuaaaagcucucaaucaaguccuaucauacccggauuugguggugacuucaaucucaccuuauuagagccaguuuccauuagcacaggcuccagaucugcaagaucugcaauagaggauuuacuguuugauaaagucacaauugccgauccuggcuacaugcaagguuaugaugacuguaugcaacaaggaccagcaucugcucgugauuuaauaugcgcacaauauguagcaggauacaagguauuaccaccuuuaauggacgucaacauggaagcagcuuauacgucuagccuacuaggcucaauugccggcgucgguuggaccgccggacuaagcucauucgcagcuauaccauuugcacaauccauuuucuaccgcuuaaauggcgucggaauaacacaacaagucuuaagcgaaaaccaaaaauuaauugccaauaaauucaaucaagcacuuggagcuaugcaaacaggguucacaaccacuaaugaagcguuuagaaagguacaagaugccguuaacaauaaugcucaagcguuaagcaaauuagcuagcgaauuaagcaauacauucggagcuauuucagcaucaauaggagacauaauucaacgccuggauguacuagaacaagacgcucaaaucgaccguuuaauaaauggacgauugacuacgcuaaacgcuuucguagcacaacaauugguaagaucagaaucagcagcauuaagcgcacaauuagcaaaggauaagguaaacgaaugugucaaagcucagucaaaaagauccggauuuugcgggcaaggcauccauauaguuucauucgucguuaaugcaccaaauggcuuauauuuuaugcauguuggauauuauccuucgaaucauauagaaguagucuccgccuacggccuaugugaugccgcaaaucccacaaacuguauagcaccaguuaaugguuauuuuauaaaaacaaacaacacuaggauaguggaugaauggucuuauacaggaaguucauucuaugcaccugaaccaauuacuucauuaaauacuaaauauguagcaccgcaagugacauaccaaaacauuucaacaaaccuaccaccaccacugcuagguaacucuaccggaauagacuuucaagacgaacucgaugaguucuucaaaaacguaucuacgaguaucccaaauuuuggaucccuaacccaaauaaacaccacacuacuagaccuuacuuaugaaaugcuaaguuuacaacaaguuguuaaagcauuaaacgaauccuauaucgacuuaaaggaacuaggcaauuacacauacuacaacaaauggccuugguacauaugguuagguuuuauagcaggccuaguugcacuagcccuuuguguauucuuuaucuuaugcugcaccggaugcgguacuaauuguauggguaaacucaaaugcaauagaugcugugacagauaugaagaauacgauuuagaaccccauaaaguacauguccacuga

SEQ ID NO: 1119 - RNA, 4062 nt, Artificial Sequence
  derived and/or modified CDS sequence (opt6) from MERS-CoV__ALJ54496__S
augauacacaguguauuuuuacuaauguuccuuuuaacucccaccgaaucauauguugauguaggaccagauucaguaaaaucagccuguauagaaguagacauacagcaaacauucuuugauaaaacuuggccucgaccaauugacguaaguaaagcagauggaauuauuuauccccaaggucgaacauacaguaacauaacaauuaccuaucagggucuauuuccauaucaaggugaucacggagacauguacguuuacucugcaggucaugccacaggcaccacuccacaaaaacuauuuguugcuaacuacucacaagaugugaaacaauuugcaaauggauuuguuguaagaauaggagcagccgcaaauagcacagguacuguuauaaucucaccaagcacaagugcaacaauucgaaaaauuuacccagcauuuauguuaggaucaagcguaggaaauuucagcgacggaaaaaugggaagguuuuucaaccacacauuaguacuacuaccagacggcuguggcacauuauuaagagcauucuacugcauacucgaaccucgauccggaaaccacugcccagccggaaacucauauacuagcuuugccacauaucauacaccagcaacugacuguucugacgguaacuauaaucguaaugcuagccuuaacucauuuaaggaauacuucaaccuaagaaauuguacuuuuauguauacuuacaauauaaccgaagaugaaauucuagaaugguucgguaucacacaaacugcccaaggaguacaucuguuuucaagccgauauguugaucuauacgguggaaauauguuucaauuugcuacuuuaccuguauacgauacaauaaaauauuauucuauuauaccucauucuaucagaucaauucaaucagacaggaaagccugggccgccuuuuauguauacaaauuacaaccauuaacauuucuucuugacuuuucugucgacggcuauauccgcagagcgauugauugcggcuucaacgaucugucucaacuacacugcucuuacgaaucuuuugacguagaaucuggaguauauucaguuagcucauuugaagccaaaccaucuggguccguaguagaacaagcagaagguguugaaugcgauuucaguccacuucucucaggaacuccuccccaaguauacaauuuuaaaagauuaguuuuuacaaauuguaacuauaaucuaacaaaauuacuuucacuauuuucaguaaacgauuucacuuguagccaaauaaguccggcagcuauagcaaguaauugcuacucaucacucauacuagacuacuucucauaucccuuaaguaugaaaucagauuuaagcguuucuuccgcuggcccuauaucacaauuuaauuauaaacaaucauuuuccaacccaacuugucuuauucuugcaacaguuccgcauaaccuaacaacuauuacuaaaccauuaaaauacucuuacauaaacaaauguucaagacuaccaagugacgacagaacugaaguaccccaauuagucaacgcuaaccaauacucuccuugcguuucuauaguacccucuacuguaugggaagauggagauuauuauagaaaacaacuuucaccacuagaaggaggggguugguugguagcaucggguucaacaguagcaaugacugaacaacuccaaauggguuucggcaucacuguccaauaugguacagauacaaauagcguauguccaaaacuagaauuugcaaaugauaccaaaauagcuucacaauugggaaauugcgucgaauauagucucuacggaguuucaggccgcgggguauuucaaaauugcacugcuguaggugucagacaacaacgauuuguuuacgaugcauaccagaaucuugucggcuacuauucugacgaugguaacuacuacugucuuagagcaugcgucuccguaccuguaucaguuaucuaugacaaagagacgaaaacacacgcuaccuuauuuggaucuguugccugugagcauauaagcucaacuaugucacaguacagcagguccacacgaagcaugcuaaaacguagagauucaacauacgguccacuccaaacacccguuggauguguucuuggccuaguaaauucaucccuauuuguagaagacuguaaauuaccauuaggacaaucauuaugugcccuaccugauacuccaucgacacuaaccccaagauccguccgaucaguaccuggagaaaugcgacuagccucaauagcauuuaaucacccaauacaaguugaucaacuaaacucaagcuacuuuaaauuauccauaccuacaaacuuuucauuuggaguuacccaagaauauauacaaacaacaauacaaaaaguaaccguugauuguaaacaguaugucugcaacggcuuucaaaaaugcgaacaacuucugcgcgaauauggccaauuuugcucuaaaauuaaccaagcacuucauggugccaauuuacgccaagaugacucuguucguaacuuauucgccagcguuaaaucaucccaaucuucgccaaucauucccgguuucgguggagauuuuaaccucacguuacuagaaccuguuuccaucaguaccggaagccgaucugcaagaucugcaauugaggauuuauuauuugacaaaguaacaauagcggaccccggcuauaugcaagguuacgacgacuguaugcaacaagguccggcaucugcucgugaucugauaugugcacaauaugucgcaggauacaaaguacuuccaccucuaauggauguaaauauggaagccgcguauacaucaucacuauuagguucaauugccggcguaggcuggacagccggacucucuucguuugcugcaauacccuuugcacaaucaauauucuauagguuaaacggaguagguauuacacaacaaguauuaucagaaaaccaaaaacuuaucgcaaauaaguuuaaucaagcucuuggugcaaugcaaacugguuuuacaacaaccaacgaagccuucagaaaaguucaagacgcugucaauaacaacgcucaagcacucuccaaacuagccucagagcuuuccaauacauuuggagccauauccgcuaguauuggagacauaauucaacgauuagauguauuagaacaagaugcccaaauugaucgacucauaaauggacgauugacaacucuaaacgcguuuguagcacaacaacuuguuaggucugagucagcugcucucagugcccaauuagcaaaagauaaaguaaaugaauguguuaaggcacaaucuaaacguuccgguuuuugcggucaaggcacgcauauaguaucauuuguaguaaacgcuccaaauggucuuuauuucaugcacguugguuauuauccaucaaaccauauagaaguaguuucugcauauggauuaugcgaugccgccaauccaacaaauugcauugccccuguaaauggauacuucaucaaaaccaauaacacccgaaucguugaugauuggucuuacacaggauccucuuuuuacgcgcccgaaccaauaacaucacuaaacaccaaguacguugcuccacaaguaacuuaucaaaacauaucuacgaaccuaccuccaccuuuacuaggcaauucaacugguauagauuuucaagaugaauuagaugaauuuuucaaaaauguaucaacaucaaucccuaacuucggaucucucacacaaauuaauaccacucuacucgauuuaacuuaugaaauguuaagccuccaacaagucguuaaagcacuaaacgaaucuuacauagaccuaaaggaacuagguaacuauacauauuacaauaaauggccuugguacaucugguuaggauucauagccggacuuguagcccuagcucucugcgucuucuuuauccuuuguuguacagguuguggaaccaauugcaugggaaaacuaaaaugcaaucgcuguugugacagauaugaagaauacgaccuagaaccccauaaaguccacguacauuag

SEQ ID NO: 1120 - RNA, 4062 nt, Artificial Sequence
  derived and/or modified CDS sequence (opt6) from MERS-CoV__ALJ54500__S
augauacauucaguuuuccuccuaauguuuuuacuuacucccacagaguccuauguugauguagggccagacagcguuaagagcgcauguauugaaguagacauacaacaaacauucuuugauaaaacauggccacgaccaauugacguaaguaaagcagacggaauaaucuauccacaaggaagaacauacuccaauauaacuaucacguaucaaggccuauuuccuuaccaaggagaucacggugacauguacguauauuccgcaggacaugcaaccgguacgacgccacaaaaauuauuuguagcaaacuacucucaagacgucaaacaauuugcaaacggguucguaguaaggauaggagcagcagcuaauucaacaggaaccguaauaauaucuccuucaaccucggccacaauacguaaaauauauccggcauucauguuaggcucaucgguuggaaauuucucagauggaaaaaugggaagauucuuuaaccauacucuuguauuacugccugauggauguggcacccugcuacgagcauuuuauugcauacuugaacccagaagugguaaucauugcccagcaggaaauucauacacauccuuugcaacuuaccauacaccagccacggauuguucagacggaaacuacaaccggaaugccuccuuaaacucuuuuaaggaauauuuuaaccucagaaauugcacauuuauguacaccuauaauauuacugaagaugaaauauuagaaugguuugguauaacucagaccgcccaagggguucauuuauuuucaaguagauauguagacuuauaugguggcaauauguuccaauuugcaacguuaccagucuaugauacaauaaaauauuauucuauaauuccucauucaauaagaucaauucagagugaucgcaaagcaugggccgcuuucuacguauacaaacuacaaccacuaaccuuucuauuagacuucucagucgauggauacauucgucgcgcgauugacugcggcuucaacgauuuaucccaauuacauugcucuuacgaaucauucgacgucgagucugguguuuacucagucucuucauuugaagcaaaaccaucaggcaguguagucgaacaagcggaaggaguugaaugcgauuucuccuuauuauuaucaggcacuccuccacaagucuauaauuucaaaagauuaguauucaccaacuguaacuauaacuugacaaaauuacuuucauuauucucuguuaacgauuucacuugcucucaaauaucuccugccgccauagcaagcaauugcuauaguucuuuaauucuugauuacuuuuccuauccauuaucaaugaaaucugaucuuuccguuucuucggcaggaccaauuucacaguuuaauuauaaacaaucauuuuccaauccaacaugucuaauacucgcuaccguaccacacaacuuaacaacuauuacaaaaccccuuaaauacucguacauuaauaaauguucuagacuacucucugacgauaggacagaagucccucaauugguaaacgcaaaccaguacucuccuuguguaaguauuguaccaucaacaguaugggaagacggagacuauuauagaaaacaauuaucuccacuugaagguggaggcugguuaguugcauccggaucaacaguugcuaugacagaacaacuucagaugggcuucggcauaacaguacaauauggaacagauaccaauucaguuugcccuaaauuagaauuugcaaacgacaccaaaauugcaagccaauuaggcaauuguguagaauacucacuauauggaguaucuggccgcggcgucuuccaaaacuguaccgcaguagguguaagacaacaacguuuuguauaugaugcauaucagaaucucgugggcuauuacucggaugaugguaauuacuacugccuucgagcaugugucucaguaccaguuucuguaauauaugauaaagaaacaaaaacacaugccacucucuucgguucaguugcuugcgaacauauuucaucaacaaugagccaauauucacguagcacccgaucaaugcuaaaaagacgugauucaaccuacgguccucuccagacaccgguuggauguguuuugggauuaguuaauucuuccuuguucguggaagauugcaaacuaccacucggacaaucauuaugcgcuuuaccagauacaccuagcacacucaccccacgaucaguacgaucuguuccaggagaaaugagauuagcgucuauagccuuuaaccauccaauacaaguagaucaacuaaacaguucuuauuuuaaacuuagcauacccacaaacuuuucauucggugugacucaagaauacauucagacaacuauccaaaaaguuacagucgacugcaaacaauauguauguaacgguuuucaaaaaugugaacaacuacuucgagaauauggacaauuuugcucaaaaaucaaccaagcccuucacggagcuaaucuucgacaagaugacucaguuagaaaucuauuugccaguguuaaaucuucacaaucauccccuauaauuccugguuucggaggagauuucaaucuaacacuacuagagccugugucaauaucaaccggcucccgauccgcaagauccgccauagaagaccuauuauucgacaaagucacuaucgcagauccagguuauaugcaaggauaugacgauugcaugcaacaaggaccagccucugcuagagaucucauuugcgcacaauacguugcaggauacaaaguucuaccgcccuuaauggauguaaacauggaagccgccuauaccucuucacuucuuggcucaauugcuggcgucggguggacagcuggucuuucuucauuugcagcaauucccuucgcacaaucaauauuuuacagauuaaacggaguagguauuacacaacaaguccuuucagaaaaucaaaaacuaauagccaauaaguucaaucaggcucuaggagcaaugcaaacaggauucacuacaacaaacgaggcuuuucgaaaaguucaagacgccguaaacaauaacgcccaggcacuuucuaaauuagcaagcgaacuuucuaacacuuuuggugcaauaucagcaucaauuggugauauuauccaacgacuagauguuuuggaacaagaugcccagaucgacagacuaauaaauggucgucuaacaacuuuaaacgcauucgucgcacaacaauuaguuagaucagaauccgcagcacucuccgcacaacuugccaaagacaaaguaaaugaauguguuaaagcacagaguaaaagaucaggauuuugcggccaaggcacucauauuguuagcuucguagucaaugccccuaacggacuuuauuuuaugcacgucgguuauuaccccucaaaccacauugaaguaguaucagcauauggucuaugcgacgcugcuaauccaacuaauuguauugcaccuguaaauggauacuucaucaagacaaauaacacuagaauaguugaugaauggagcuauacaggaucuucuuuuuacgcaccugaaccaaucaccagccuuaacacuaaauaugucgcgccucaaguaacuuaucaaaacauuucaacaaacuuaccuccaccauuacucggcaauucaaccggaauagauuuccaagaugaauuagacgaauuuuucaaaaauguaucaacauccauccccaacuuuggauccuuaacacaaauaaauacuacacuacuagaucuaacuuaugaaaugcucagucuacaacaagucguaaaagcacuuaacgaaagcuacauagauuuaaaagaacuuggaaacuauacauacuacaauaaauggccgugguauauuuggcuugguuucauagccggauuaguggcccuagccuuauguguauucuuuauauuauguugcacaggaugcggcaccaacuguaugggaaaacucaaaugcaauagauguugugauagauacgaagaauacgauuuagaaccacacaaaguacauguacauuaa

SEQ ID NO: 1121 - RNA, 4062 nt, Artificial Sequence
  derived and/or modified CDS sequence (opt6) from MERS-CoV__ALJ54501__S
augauucauuccguguuuuuacuaauguuccucuuaacuccaacagaaucuuauguagauguaggaccugauaguguaaaaucagcauguauagaaguugauauacaacaaacauucuuugauaaaacauggccuagaccuauugacgucaguaaagcagacggaauuauauauccacaaggacguacauauucuaauaucacaauaacuuaccaaggauuauuucccuaucaaggagaccacggugacauguauguuuacagugcaggccacgccaccggcaccacaccccaaaaacucuuuguagcaaauuacucacaagacgucaagcaauuugcaaacggauucgucguucgaauaggggcugccgcaaacucaacagguacugugauuauuucaccaucaacuucagcaacgauaagaaaaauauaucccgcauuuauguuaggaagcaguguaggcaauuuuagugauggcaagauggguagauuuuucaaucacacucuuguccucuugccugauggauguggaaccuuauuaagagcauucuauuguauuuuagaaccaagauccggcaaucauugucccgcaggcaacucguauacuucuuucgcuacauaccauaccccagcuacugacugcucagauggaaauuauaaucgaaaugcaucacuaaauagcuucaaggaauacuucaaccuacgcaauugcacuuucauguacacuuauaauauuacagaagaugaaauacuagagugguucggaauuacucaaaccgcucaaggaguucaccuauuuucuucaagauaugucgacuuauacggcggaaacauguuucaauuugcuaccuuaccagucuacgauacaauuaaauauuacuccauuauaccacauucgauucgaucuauucaaucagaccguaaagcaugggcagcauucuauguauauaaacuucaaccgcuuaccuuucuucuugauuucucugucgauggauauauaagacgugcaaucgauugugguuuuaacgacuuaucucaauuacacugcucauacgaaucauucgauguugaaucagguguauauaguguaucaucauuugaagccaaaccaucaggcuccgucguagaacaagcagaaggaguagaaugugacuucagucccuuauuauccggaacaccaccucaaguuuacaauuucaaacgcuugguauucacaaauugcaauuauaauuuaaccaagcuauuaucucuuuuuaguguuaaugacuuuaccugcucacagauauccccagcagcaauugcaucuaacugcuauucaucccuaauucuagauuauuuuaguuauccacuauccaugaaaagcgaccuaucaguauccuccgcaggaccuauaucucaauucaacuauaaacaaucuuucucaaacccaacaugucucauacucgcaacuguaccacauaaucuuaccacaauaacaaaaccucuaaaauauagcuauaucaauaaaugcucccgacuucucucagaugacagaacugaaguaccucagcuaguuaaugcuaaccaauacucacccugcguguccaucgucccaaguacacuuugggaagacggggacuacuauagaaaacaauuaaguccacuagaaggaggagguuggcuaguugcaucaggcucaacuguagccaugacagaacaacuccaaaugggauuuggcauaacagugcaauauggaaccgauacaaacaguguaugcccuaaguuagaguuugcaaaugacacaaaaauagcgucacaauuaggaaacuguguagaauauucauuauauggugucaguggcagaggcguauuucaaaauugcacagcugucggaguucgccaacaacgguuuguauacgaugcguaucaaaaucucguaggauauuacucugaugacggcaacuauuauugucuccgggccugcguuucuguccccguaucaguaauuuacgauaaagaaacaaaaacucaugcaacucuauuugggucuguagcaugcgaacacauaucaagcacaaugucacaauacucaagaucaacaagaucaaugcuuaaaagacgugacucaaccuaugggccacuacaaacaccaguuggauguguauuaggucuaguuaauuccaguuuauuugucgaagacugcaaacuaccgcuaggucaaucccucugugcccucccagacaccccauccacuuuaacacccagaucaguaagaaguguaccuggugaaaugagacuagcauccauugcauucaaucacccaauacagguagaccagcuaaauagcucauauuuuaaacuaucuauacccacaaauuucuccuuuggugugacucaagaauauauucaaaccacaauacaaaaaguuacugucgacuguaaacaauacguuugcaacggauuucaaaagugugaacaauuacuacgcgaauacggccaauuuugcagcaaaaucaaucaagcacuacauggagcuaauuuacgccaagaugauagcguaagaaaucucuuugccucugucaaaucuucacaaucaucaccaaucauucccggcuucggcggagacuuuaacuuaacuuugcuagaaccaguaucuauaucuacgggcucaagaucagccagaagugcaauagaggauuuauuauucgauaaaguaacaauagcugauccagguuauaugcaaggcuacgaugauuguaugcaacaaggaccugcaucggcaagagaucugauuugugcacaguaugucgcaggauauaaagucuuaccaccacuaauggauguaaauauggaggccgcuuauacaucgagcuuacuugguucuauagcuggaguagguuggacagccggguuaagcucauuugcagcuauaccauuugcccagucuauauucuaucgccuaaauggaguuggaauaacacaacaaguacucucagaaaaucaaaaauuaauugccaacaaauucaaucaagcucuuggagcuaugcaaacagguuucacaacuacaaaugaggcuuucaggaaagugcaagaugcuguaaacaauaaugcacaagcacuaucaaaacuugccucagaacucuccaauacauuuggagcuauaucagcuuccaucggugacauuauacagagacuagacguauuagaacaagacgcacaaauagaccgauuaauaaacggacguuuaacaacuuuaaacgcauuugucgcucaacaauuaguuagaagugaaagugcugcacuaucagcccaacuagcaaaagacaaagucaaugaauguguuaaggcucagagcaaacgaucuggauucuguggacaaggaacacacauuguaaguuucguuguaaaugcaccaaauggacuauauuuuaugcacguugguuacuacccuucaaaucauauagaaguugugagugcuuacggauuaugugaugcagcuaacccaacaaauugcauagccccagugaacgguuacuuuauuaaaacuaauaacacacgaauaguugaugaauggucuuauacuggaagcucuuuuuaugcucccgaaccuauuacuucccucaauacuaaauacguagcuccccaaguaacauaccaaaacauuuccaccaauuuaccaccuccccuucuugguaauucaacugggauagauuuccaagacgaacucgaugaauuuuucaaaaacgucuccacaagcauucccaauuuugguucccugacacagauuaacacuacacuacucgaucucacuuaugaaaugcuaagccuucaacaagucguaaaagcccuuaacgaaucauauauagauuuaaaagaacucggaaacuauacguauuauaacaaauggcccugguacauaugguuaggauuuauugcuggacuuguggcacuagcacuuuguguuuucuuuauacuaugcuguaccgguugugguacgaauuguauggguaaacuaaaauguaaucguuguugugaucgcuaugaagaauaugauuuagaaccccacaaaguucauguccauuaa

SEQ ID NO: 1122 - RNA, 4062 nt, Artificial Sequence
  derived and/or modified CDS sequence (opt6) from MERS-CoV__ALJ54502__S
augauucauucaguauuucuuuuaauguuuuuauuaacacccacagaaaguuauguugacguagguccagauucaguuaaaucagcguguauagaagucgauauacaacaaacauucuuugacaaaacauggccuagaccuauagacguaucaaaagcugaugguauaauauauccacaagguagaacuuacucaaauaucaccaucacuuaucagggacuuuuuccauaucaaggcgaucauggagacauguaugucuauagcgccggucacgcuacuggaacaacgccucaaaaacuauuuguagcuaacuauagccaagaugucaaacaauuugcaaacggauucgucgucagaauuggugcagcugcaaacucaaccgguacaguaauaauaucacccucuacgucugcaacuauucgcaaaauuuauccagccuuuaugcuaggaucauccgucggaaauuuuucugaugguaaaauggggagauucuuuaaccauacccuaguauuauuaccugauggcugugguacacuauuacgagccuucuacugcauauuagaaccccgaagcgguaaucauugccccgcagguaauagcuauacauccuucgcaacauaccauacuccugccacagacugcuccgaugguaacuacaaucgcaacgcaagucuaaacucauucaaagaauauuucaacuuaagaaacuguacguuuauguacacuuacaacauaacugaagaugaaauacucgaaugguuugguaucacccaaaccgcacaaggcguacacuuauucuccucacgguaugucgaccuauauggcggaaauauguuccaauuugcaacucuaccaguuuaugauaccauuaaauacuacucaaucauaccucauucuauacguuccauacaaucagacagaaaagcaugggcagcauuuuauguauauaaauuacaaccacuuacauuuuuauuagauuuuaguguagauggcuauauacguagggccaucgacugcggauuuaacgaccuuucacaacuacauugcaguuaugaaaguuuugauguugaauccgguguuuauaguguuucauccuucgaagcuaaaccauccgguucaguaguagaacaagccgaaggaguugaaugcgacuucuccccacuucuuaguggaacucccccacaaguauacaauuuuaagcgauuaguauucacaaacuguaauuacaaccuaacaaagcuguugucacuuuucucgguuaaugauuucacuuguucacaaauaucccccgcugcaauagcaucaaauugcuauucuucucuuauacuugauuauuucucuuacccucucuccaugaaaucagauuuguccguuucaucugcaggaccuauaucccaauucaacuauaaacaaucauuuagcaaucccacuugccucauacuugccaccguaccacacaaccucacaacuaucacgaaaccacuaaaauauucuuauauaaacaaaugcagucguuuauuaucagaugacagaacugaaguaccucaguuaguuaaugcgaaucaguauucacccuguguuucuauuguuccaucaacaguaugggaagacggcgacuacuaccgaaaacaacucaguccacuugaagguggaggauggcuuguagcaucaggaucaacugucgcaaugacagaacaacuacaaaugggauucggaauuacgguacaauauggaacugauacaaauucuguuuguccaaaauuagaguucgccaacgauacaaaaauugccagucaacuugguaauuguguugaauacuccuuauacgguguaucaggacgcggagucuuucaaaauugcacagcaguuggcguuagacaacagagguuugucuacgaugccuaccaaaacuuagucggauauuacucugaugauggaaauuacuauugccuucgagcauguguaagcguuccugugucaguaauuuacgauaaagaaacaaaaacccaugcuaccuuauuugggucaguugcaugcgaacacaucucaucaaccaugucacaauacucaagaucaaccagaagcauguuaaaacgacgagacuccacauacggcccuuuacaaacuccuguuggcugcguacucggcuuaguaaacaguuccuuauuuguugaagauugcaaacuaccauuaggucaaucauuaugcgcacucccggacacaccuucaacucuuacgcccagaaguguacggucaguuccuggugaaaugcgguuagcgucuauagccuucaaccaucccauacaagucgaucaauuaaauagcucauauuuuaaacuauccauaccuacuaauuucaguuuuggaguaacccaagaauauauacaaacaacgauucaaaaaguaacaguagauuguaaacaauacguuuguaauggauuucaaaaaugcgaacaauuacuuagagaauacggacaauucugcaguaaaauaaaucaggcauugcauggugcuaaucuuagacaagaugauucgguuagaaaccuauucgcaucaguuaaauccagccaaaguucaccuauuauaccaggcuuuggaggagacuucaauuuaacacucuuagaaccaguuucaauuucaacaggaucuagaagugcaagauccgcuauagaagaucuacuuuuugauaaagucacaauugcugaucccggcuacaugcaaggguacgaugauugcaugcaacaaggucccgccucgguacgagaccuuauaugcgcacaauacguagcaggguacaaaguccuaccuccauuaauggacguaaauauggaagccgcuuauacaucuagcuuacuaggaagcaucgccggcguuggcuggacugccggauuaucuucguucgccgccauaccuuucgcacagucuauauuuuaccgccuaaauggcguaggaauaacccaacaaguauuaagcgaaaaccaaaaauuaauagcuaacaaauuuaaucaagcacuaggcgcuaugcaaacaggauucaccacuacaaaugaggcuuuccggaagguccaagaugcaguuaauaauaaugcacaagcacuaucuaaacuagcgucugaacugucaaauacauuuggagcaaucucggccucaauuggagauaucauucaaagacuagauguacucgaacaagaugcacagauagaucgcuuaauaaauggucgcuuaacaacauuaaacgcuuuuguagcacaacaauuaguacgaucagaaucagcagcauuaucugcacaacuugccaaagauaaagucaacgaaugcgucaaggcacagaguaaacgauccggauuuuguggucaaggaacgcauauuguuucuuuugucgugaacgcaccaaaugguuuauacuucaugcacgucggcuacuacccuucaaaucacauugaaguuguaucugccuauggacucugugacgcugcuaauccuacaaauuguauagcccccguaaacggcuauuuuauaaaaacaaauaauacucgaauuguagacgaauggucauauacuggaucaucuuucuaugcccccgaaccaauaacauccuuaaauacaaaauacguagcaccacaagucacauaucaaaacauaaguacaaaucuuccuccaccucucuuaggcaauaguacggguaucgacuuccaagaugaacuugaugaauuuuucaaaaacguaucaacaaguauaccaaauuuuggauccuugacucaaauaaauaccacucugcuugauuuaacauacgaaaugcuaucacuccaacaaguagucaaggcuuuaaaugaaucauauauugaccuuaaagaauuagguaacuauacguacuacaauaaauggccuugguauauuuggcuugguuuuauugcuggucuaguugcauuggcucuuugugucuucuuuauauuauguuguaccgguugugguacuaacugcaugggcaaacuuaaauuuaauagauguugcgacagauacgaagaauacgaucuugaaccucacaaaguucauguacauuaa

SEQ ID NO: 1123 - RNA, 4062 nt, Artificial Sequence
  derived and/or modified CDS sequence (opt6) from MERS-CoV__ALJ54512__S
augauccacagcguuuuucuacuaauguuuuuauugacccccacagaaucuuacgucgacgucggaccugacucaguaaaauccgccugcaucgaagucgauauacaacaaacauuuuucgauaaaacuuggccacgacccaucgaugucucaaaagcugauggaauaaucuauccacaaggacggacuuacucaaacauaacuaucacauaucaaggucucuuuccauaccaaggagaucauggugacauguauguauacucggcuggacacgcaacaggaacaacaccacaaaaacucuucguagcaaauuacucucaggauguaaaacaauuugccaauggauuuguuguccguaucggagcagcagcaaacucaacugggacaguuauaaucucacccucuacgagcgcaacuauucgcaaaauuuauccugcauuuaugcucggaagcucagucgguaauuuuuccgauggaaaaaugggacguuucuuuaaccauacccucguuuuauugccagauggaugcggaaccuuauuaagagccuuuuauugcauacucgaaccacggagcggaaaccacuguccagcuggcaauuccuauacaucauuugccacauaccacacaccagcuacugauugcagcgacggaaacuauaauagaaacgcaucgcuuaauagcuucaaagaauacuucaaccucagaaauugcacuuucauguauacauacaauaucacagaagacgaaauccuugaaugguucggaaucacacaaacugcacaaggugcacaccuauuuucuucaagauacgucgaccuauauggagguaacauguuccaauucgcuaccuuaccagucuaugauacaaucaaauacuauucuauuauaccucauagcauaagaucaauccaaucagacagaaaggcuugggcugcuuucuaugucuauaaauuacagccucuuacauuuuuacuagauuucuccgucgacggauauauucgacgugccaucgauuguggauucaacgaucuaucccaacuucacugcucauacgagagcuucgacguagaaucaggaguauacaguguaucuucuuucgaagccaaaccaucagguucaguaguagaacaagcagaaggcguugaaugcgauuuuucaccucuucuuagugggacuccuccacaagucuacaauuucaaaagacuuguuuucacaaauuguaacuauaacuuaacaaaacuauuaucauuauuuagcguaaacgauuuuacaugcucacaaauauccccugcagcaauagcuucuaauugcuacucaucucucauauuagacuacuucaguuaccccuuaucaaugaaaucugaucuuucgguuuccagugccggaccaauuucucaauucaacuauaaacaaucuuuuagcaauccgacaugucuaauacuagccacugugccucauaaccuaacaacaauaacaaaaccauuaaaauauucuuauaucaauaaaugcagucgauuauuaucagacgauagaaccgaagugccucaauuaguuaaugcaaaccaauacagucccuguguaucuauuguaccuaguacagucugggaagauggagacuauuaucguaaacaauuaucaccacucgaaggaggaggcuggcuaguagcuuccggcucaacagucgcaaugacagaacaacuccaaaugggauuugguauaacuguucaauacggaaccgacacaaauaguguuuguccuaaacuagaauuugcaaaugauacgaaaauagcuucacagcucggcaacugcguagaauacucuuuauaugggguuucaggacgcggcguauuucaaaauugcacagccguuggggugagacaacaacgcuuuguauaugaugcauaccaaaaccuagucggcuacuauucagacgacgguaacuauuacuguuuaagagcuugugucucaguuccuguaagcguaauauaugauaaagaaacaaaaacacacgccacccucuuuggaucuguugccugcgaacauauuaguucaacuaugucccaauacucacgauccacucgcagcauguuaaaacgacgagauucaacauaugguccucuacaaaccccaguuggauguguacuaggucuaguaaacucgucccuuuuuguugaagacuguaaacucccucuuggacaaucacucugugccuuaccagauacaccgucaacucucacuccccgaagcgucagaaguguccccggagaaaugagacucgcaucaauagcuuuuaaucacccaauacaaguagaccaauuaaauuccaguuauuucaaacucucaauuccaacaaacuuuagcuuuggcguaacacaggaguauauacaaacaacaauucaaaaaguaaccguugauuguaaacaauauguaugcaauggcuuucaaaaaugugaacagcugcuaagagaauaugggcaguucuguucuaagaucaaucaggcuuuacauggagcaaacuuaagacaagaugacaguguuagaaacuuauuugccuccgucaaaagcagucaaucaucaccaaucauuccuggauuuggaggugauuuuaaucuaacacuacuugaaccagucaguauaucaaccggaaguagaagugcacgcucagccaucgaagaccucuuauucgauaaaguuacaauagccgauccaggauauaugcaagguuaugaugauuguaugcaacaaggaccagcuuccgcacgugaucucauuugcgcacaauacguugcgggauauaaagucuuaccuccauuaauggacgucaauauggaagcagccuacacaucaucauugcuagguucuauagcugguguuggauggacugcgggccucuccuccuuugccgccauaccauuugcccaaaguauauuuuauaggcucaacggaguagguauuacccagcaaguucuuucagaaaaucaaaaacuuaucgcuaauaaauuuaaucaagcucucggagcuaugcaaacgggauuuacaacaacuaaugaagcauucagaaaaguccaagaugcaguuaauaauaaugcacaagcacuuucaaaacuagcaucagaacuaucaaauacuuuuggugcaaucagcgccagcauaggcgauauaauacaaagauuagacguucuugaacaggacgcucagauagaucgcuuaaucaacggaagacucacuacacuuaaugcuuucguagcacaacaacuugugcgauccgaaucugcugcucuuuccgcccaacucgccaaagacaaaguuaaugaaugcgucaaagcacaaucaaaaagaucaggcuucuguggacaaggaacucacaucgugucuuucguaguaaaugcaccaaacggauuauauuucaugcauguaggcuauuaccccucaaaucauauugagguagucagugccuauggauuaugcgaugcagccaaucccacaaacuguauagcuccaguaaacggauauuucaucaaaacaaauaacacaagaaucgucgacgaaugguccuacacggguagcucuuuuuaugcaccagaacccaucacuucacuaaacacuaaauauguugcaccacaaguuacauaccaaaauauaagcacuaauuuaccuccaccauuacuagguaacucgacaggaauugauuuucaggaugaauuagaugaauuuuucaaaaacguaucaacaucgauaccaaauuucggcuccuugacacaaauaaauacaacacucuuagauuuaacauaugaaauguuaucuuuacaacaagucgugaaagccuugaacgaaucauauauagaucuaaaagaacuagguaauuacacuuauuauaacaaauggccuugguauauauggcuagguuucauugccggucuuguagcguuggcuuuaugcguauucuuuauucuauguuguacuggcuguggaacuaacugcauggguaaacuuaaauguaacagauguugcgaucgauacgaagaauaugaccuagaaccccauaaaguucacguccauuaa

SEQ ID NO: 1124 - RNA, 4062 nt, Artificial Sequence
  derived and/or modified CDS sequence (opt6) from MERS-CoV__ALJ54517__S
augauacauaguguauuucuucucauguuuuuacuuacacccacagaaucauacguugaugucggacccgauuccgucaagucagcuuguaucgaaguagacauacaacaaacuuucuuugacaaaacauggccucggccuauagacguaucuaaagcagauggaauuauauauccucaaggacgaacuuauuccaacauaacaauaaccuaucaaggucuuuuucccuaccaaggugaccacggcgauauguauguuuacucagcaggacaugcaacugguaccacuccucagaaauuauuugucgccaauuauagccaagacgucaaacaauuugcaaacggauuugucguccgaauaggcgcugcagcaaauucaacuggcaccguaauuauuucucccucaacaucugcaaccauaagaaaaauauauccagcuuuuaugcuaggaucaucagugggaaauuucucugauggcaaaaugggaagguucuucaaucacacuuuaguacuuuuaccagaugguugcgguaccuuauuacgagcauuuuacugcauauuagaaccacguuccggaaaucauugcccagcaggcaacucauacacuucauucgcuacauaccacacaccggcaaccgacuguucugacggaaacuauaaucgaaaugcuucacucaauuccuucaaagaauacuuuaauuuaagaaauuguacuuucauguauacauauaauauaaccgaagaugaaauccuugaaugguuugguauuacucaaacugcucaaggaguccaucucuuuucuucacgauauguagaucuauacggaggaaacauguuucaauuugcuacacucccaguuuacgauaccauaaaauauuacucuauaauaccucauucuauaaggucaauacagucugauagaaaagcaugggcagccuucuauguuuauaaacuacaaccacuaacauuuuuauuagauuuuuccguagauggauacauacgucgagcuauugauugcggauuuaacgauuuaagccaauuacauuguucauaugaaucuuuugauguugaauccggaguauauucaguaucaucauuugaagccaaaccgucaggaucagucguagaacaagcagaaggaguagaaugugacuuuucuccacuacugucuggaacaccaccacaaguuuacaacuucaaaagacucgucuuuaccaauuguaauuauaauuuaacaaaauuacuaucucuauucuccgucaacgauuuuacuugcagccaaauauccccagcagccauagcgucuaauuguuacucuucccuuauucucgauuauuuuuccuacccccuuucaaugaaaucagaccuguccgucucuucagcaggaccaauaucacaauuuaacuacaaacaaucuuuuucaaacccaaccugccuaauuuuagccacaguaccacacaaucuaaccaccauaacaaaaccacuaaaauacagcuauauuaauaaauguucucgacuucuauccgaugaccgaacugaaguuccacaauuagucaacgcgaaccaauauucuccaugugucucaauagucccuucuacaguaugggaagacggaaacuauuaucgaaaacaauugucccccuuagaaggaggcgguuggcuaguugcaucuggcuccacuguugcuaugacagagcaauuacaaaugggcuuuggaauaacuguccaauacggcacggacacaaacucaguuuguccaaaguuagaauuugcaaaugauaccaaaauagcaucacaacuugguaacuguguagaauauagcuuauauggagucaguggacgaggagucuuccaaaacugcacagcagucggaguaaggcaacaacgauucguuuaugaugcauaccaaaaucuaguaggauacuacucagacgacggaaacuauuacugccuucgugcuuguguuucaguucccgucucaguaauauacgacaaagagaccaaaacccacgcuacauuauuuggcucuguugcaugugaacacauuucaucuaccaugucucaauauucaagaagcacaagaaguaugcuaaagagaagagacuccacauauggaccuuuacaaacaccuguggguuguguucuaggauuagugaacucgagucuauucguagaagauugcaaacuaccuuuaggacagagcuuaugugcacuuccagauacgccaucaacauuaacgccuagaagcguacggaguguaccaggagaaaugcgcuuagccagcauugcuuucaaccaucccauccaagucgaccaacuuaacuccucauauuuuaaacuaucuaucccuacuaacuucuccuuuggcgucacucaagaauauauacagacaacaauacaaaaaguuacaguagauuguaaacaauacguuugcaaugguuuucaaaaaugugaacaacucuuaagagaauauggucaauucuguaguaaaaucaaccaagcacuccauggugcaaaccuacgacaggacgacucagucagaaauuuauuugccucagugaaaucuucacaaucuagcccgaucaucccuggcuuugguggagauuuuaaucucacuuuacuagaaccagucucaaucaguacagguucucgaucagcaagaucugccauagaagaucuccucuuugauaaaguaaccauagcggauccaggauacaugcaaggauaugacgacuguaugcaacaagguccugcuuccgcuagagacuuaauaugugcgcaauacguugcuggauauaaagugcuaccaccauuaauggacgucaauauggaagcagcuuacaccucaucucuauuaggaucaauagcugguguaggauggacagcuggccuuaguucauucgcagcaauuccuuuugcacaauccauauucuauagacucaaugguguaggaauaacucaacaaguauuaucagaaaaucaaaaacucauagccaauaaauuuaaccaagcauuaggggcaaugcaaacaggauucacuacaacuaaugaagcguuucgaaaaguacaagaugcuguuaacaauaacgcccaggcccucuccaaauuagcgucagaacuaucuaauacuuuuggagcaauaucagcaucaauaggugauauuauacaacgacuggacguacuugagcaagacgcucaaauagauagacucauaaacggcagacucacuacuuuaaacgcuuuugucgcgcaacaauuaguaagaucugaaucagcagcccuaucugcccaauuagcuaaagacaaagucaaugaaugcguaaaagcacagucaaagcgaucgggauuuugcggacagggaacacauauugucucguuugugguaaaugcccccaauggauuauauuuuaugcauguugguuacuauccaaguaaucacauagaaguuguaucagcuuauggauuaugugaugccgcaaacccuacuaacuguauagccccuguaaauggcuacuucauuaaaaccaauaacacccgaauaguagaugaauggucuuacaccggcucaaguuucuaugccccagaaccuauuaccagucuaaacacaaaauauguagcuccacaagucacauaucaaaacaucagcaccaaucuaccaccuccacuauuaggaaauuccacaagaauugacuuucaagaugaacucgaugaauuuuucaaaaaugucucaacgucuauaccaaauuucgguagucuaacccaaauaaauacgacacuccucgaucuuacguacgaaaugcugagucuacaacaaguaguaaaagcucucaaugaaucauacauagacuuaaaggaauuaggaaauuauacauauuacaacaaauggccuugguacauaugguuaggcuuuauugcugggcuuguagcacuugcccuuugcguauucuuuaucuuaugcugcacugguugugggacaaacuguaugggaaaacuaaaaugcaaucgcugcugugauagauacgaagaauaugaucuggaaccccacaaaguacacguccauuaa

SEQ ID NO: 1125 - RNA, 4062 nt, Artificial Sequence
  derived and/or modified CDS sequence (opt6) from MERS-CoV__ALJ54518__S
augauacauuccguauuucuucuaauguuucucuuaacuccaacggagucuuacguugauguaggaccugauucuguuaaaucggccugcauagaagucgacauucaacaaacauucuuugauaaaaccuggccacgaccaaucgacguaucaaaagcagauggaauuauauacccacaaggacgaacuuauagcaacauuacuauaacauaucaaggacuuuuuccauaucaaggugaucauggugacauguacguauacucagcaggucaugcaacaggcacaaccccacaaaaacuauuuguagcuaauuacucucaagauguaaaacaauuugcaaacggcuuuguaguucgaauaggagccgcagccaacuccaccggaacaguaauuauaucuccuaguacaucugcuacaauuagaaaaauauaccccgcauuuaugcuuggaucaucaguaggaaauuucucugauggaaaaaugggaagauuuuucaaccauacauuaguauuacucccagauggauguggaacacuccuacgcgcauucuacugcaucuuagaaccgagauccggcaaucacuguccagcaggaaauaguuacacauccuucgcuacauaccauacgccagcaaccgacugcucagacggaaauuauaauagaaaugcuagucucaauucauucaaagaauauuuuaauuuaagaaacuguaccuuuauguacaccuauaauauuacggaggaugaaauucuugaaugguucgguauaacacaaacggcacaaggaguacaucuguuuuccagucgcuauguagaccuauacggaggaaauauguuucaguucgcuacacuucccguauacgacacuauaaaguacuauucaaucaucccacacucuauucgaucaauacaaucagauagaaaagccugggccgcauucuacguauauaaauuacaaccucucacauuccuacuagauuuuucaguagaugguuauauuagacgagcaauagacuguggauucaacgacuugagccaauuacacugcucuuaugaaucauuugaugucgaaucaggcguuuacagcguuuccucuuucgaagcuaaacccucaggcucuguaguggaacaagccgaaggagucgaaugugauuucagcccacuucucuccggaacucccccucaaguauauaauuuuaaaagauuggucuuuaccaauuguaauuauaaucuuacuaaacucuugucacuauuuucuguaaaugauuuuacaugcucucaaaucagcccugcagcaaucgcuuccaacugcuacucuucccuaaucuuagacuauuuuucuuacccucuuagcaugaaaucugaucucucgguaucuucggccggaccuauaucccaauuuaacuauaagcaaucauuuucaaacccaacaugccuuauuuuagcaaccguaccucauaacuuaacuacgauuacgaaaccacuuaaauauucuuacaucaauaaauguagcagacuuccuucagacgaucgaaccgaaguaccacaacuuguaaacgcuaaucaguauaguccaugcguaucaauaguaccaaguacgguaugggaagauggcgauuauuauaggaaacaauuaucaccuuuagaaggagguggauggcugguggcaucuggaucuacuguugccaugaccgaacaacuacaaaugggauucggcauaacaguucaauauggaacugacacuaauucagucugcccaaaacucgaauuugcaaaugacacuaaaauagccucacaacuuggaaauuguguugaauacucacuauaugguguauccggucguggugucuuucaaaauugcacagcaguaggaguaagacaacaaagauuuguauacgacgcauaucaaaaccuaguaggcuauuacucagaugacggcaauuacuacugucuucgcgcgugcgucuccguaccaguaucuguaaucuaugacaaagagacgaaaacacacgccaccuuauucgguuccguagccugugaacauauaucaucaacuaugagucaauacaguagauccacccgauccaugcucaaacgccgagauucaaccuauggcccuuuacaaacaccuguaggaugcguccuaggacucguuaauaguuccuuauuuguagaggacugcaaauuaccacucggucaaagucucugugcacuuccagauacuccaucaacccucacaccccguucgguccguucaguaccuggagaaaugcgacuagcauccaucgccuucaaucauccgauacaaguagaucaacuaaauucuucauacuuuaaauuauccauuccaacuaauuucuccuuuggcguaacccaagaauauauucaaaccacuauacaaaaaguaaccguugacugcaaacaauacguauguaauggauuccaaaaaugugaacaacuacuaagagaauacggccaauuuugcucuaagaucaaccaagcccuucacggcgcuaacuuaagacaggaugauucugucaggaaucuauuugcgucaguaaaaagcucacaaucgucuccuauuauaccaggcuuugguggggauuucaauuuaaccuuacuugaaccugucucaauaucaacuggaucccgaagcgcccggagcgcuauagaagacuuguuauuugacaagguaaccauagcggaccccggauauaugcaagguuaugaugauuguaugcaacaagguccugcuucagcuagagaucuaauuugcgcacaauaugucgccgguuauaaagucuuaccuccacuuauggauguaaacauggaagcagccuacaccucuucacuucucgguucuauagcuggaguaggauggacugcuggucuaucgucauuugccgccaucccauuugcucaaagcauuuucuauagauuaaacggcguuggcauuacgcagcaaguucuaagugaaaaucaaaaauuaauagcuaauaaauucaaucaggcccucggugcaaugcaaacaggauuuacaacuacuaacgaagcauuucgcaaaguccaagacgcuguuaacaauaaugcacaagcauuaaguaaacuagccagcgaauuaucuaauaccuucggugccauuuccgcgagcauaggagauauuauacaaaggcuagacguauuagaacaagaugcacaaaucgaucgacucauuaauggacgacucacaacauuaaaugcuuucgucgcccaacaacuuguaagaucugaaucggcugcccuuucugcccaacuagcaaaagacaagguuaaugaaugcguaaaagcccaaucaaaaagaucugguuuuugcggacagggcacacauauaguaaguuuugucgucaaugcuccaaauggauuauauuuuaugcacguaggauacuauccuucuaaccacauagaaguuguuucagcuuacgguuuaugugacgcagcaaacccuacaaauugcaucgcaccagucaauggauacuuuauaaaaacaaauaauacucgcaucgucgacgaauggucuuauacaggcuccucauucuacgcaccagaacccauaacaucacuaaacacaaaauauguugcuccccaaguuacauaucaaaacauaucgacuaauuuaccaccaccacuauuaggaaauucaacagguauagauuuccaagaugagcuagacgaauuuuucaaaaauguaucaacauccauucccaauuuugguucucuaacacaaaucaauacuacccuauuagacuuaacuuaugaaauguuaucucuucaacaaguuguaaaagcucuaaacgaaucauacauagaccuaaaagaacuagguaauuacacauauuauaacaaauggccaugguacauuuggcucgguuucauagcaggccuaguugcauuagcacuuuguguauucuuuauuuuauguugcacaggauguggcacaaauuguauggggaagcucaaaugcaaucgaugcugugaccgauaugaagaauacgauuuagaaccccauaaagugcauguacauuaa

SEQ ID NO: 1126 - RNA, 4062 nt, Artificial Sequence
  derived and/or modified CDS sequence (opt6) from MERS-CoV__ALW82691__S
augauacauucuguauuccuacuaauguuucuucuaacaccuacagaaucauacguugacgugggucccgacucaguuaaaucagcuuguauugaaguugauauacagcaaacauuuuucgacaagacauggccaagaccaauugacgugagcaaagcagauggaauaauauauccucaaggacguacauauuccaacauuacaaucacauaucaaggucuauuccccuaccaaggugaucacggagauauguacguauacucugcuggacacgcuacuggcacaaccccucaaaaacucuuuguugccaacuacucacaagacgucaaacaauuugcaaauggauucgugguacgaaucggcgccgcugcaaacaguacuggaaccguaauuauaaguccaucuaccagugccacuauccgaaaaauauacccugcuuuuaugcuagguuccucaguagguaacuuuucagauggcaaaaugggaagauucuuuaaccauacucuuguccuccucccagauggaugcggcacucuucuaagggcuuuuuauugcauccuagaaccacgaucugguaaucauugucccgcaggcaacucuuauacaaguuuugcuacuuaccauacuccugcaacugauugcuccgacgguaauuauaauagaaacgcuucacuuaauucuuuuaaagaauauuuuaauuuaagaaacugcacuuuuauguacacauacaauaucacugaagaugaaauacuagaaugguuuggaauuacucaaacagcacaaggaguucaucuauuuucaucgagauauguagaccuauacggcggaaauauguuccaguucgcuacccuccccguauacgauacaauaaaauauuauucaaucauuccacauucaauucguucaauccaaucagaccgaaaagccugggcagccuucuaugucuacaaauuacaacccuuaacuuuucuauuggauuuuucaguagauggauauauucguagagcgauagauuguggcuuuaacgaccuaucccagcuccauugcucuuaugaauccuuugauguugaaucaggagucuacaguguuagcaguuucgaagcaaaaccaucagguucuguuguagaacaagccgaaggaguagaaugugauuuuucaccguuauuaucaggcaccccaccgcaagucuauaauuuuaagcgucucguauucaccaacugcaacuacaaccuaacuaaauuacucucguuauucucugucaacgauuucacaugcucccaaaucagcccagcagcaauagcaucaaauuguuacucuucauuaauacuugauuauuuuagcuauccccuaucuaugaaauccgauuuaucuguaucaagugcuggccccauuucacaauucaauuauaaacaaaguuuuucgaacccaaccuguuuaauccucgcaacugucccccauaaccugaccacuauuacaaaaccacuaaaauacagcuauauuaauaaauguucaagacuacgaagcgacgaucgcacagagguaccacaacuuguaaaugcaaaucaauacaguccuuguguuucaaucgugccaucuacaguuugggaagacggagauuauuaucgaaaacaauuaucacccuuagaaggagguggaugguuaguggcaucuggauccacuguugccaugacggaacagcuucaaaugggcuuuggaauuacaguacaguacgguacagauaccaauucagugugccccaaacuagaauuugcaaaugauacaaaaauugcaucacaacuuggaaauugcguugaauacagccucuauggaguaaguggcagagguguuuuccagaacugcaccgcagucggcguaagacaacaaagauucguauaugacgcguaucaaaaccuaguaggauacuauucugaugacggaaacuauuauuguuuaagagcuugugucuccguaccagucuccguuauuuaugauaaagaaacaaaaacucacgcaacucuauuuggcaguguagcuugugaacacauaagcuccacuaugagccaauauucccgaucuacccgaucaaugcuaaaacgucgagacucuacuuauggcccucuacaaacccccguugguugcguucuuggucuaguaaacucuucacucuucgucgaagacugcaaacuuccccuaggacaaucucuaugcgcucuaccugauaccccuagcacauuaacgccuagaucaguaagaucaguacccggcgaaaugcgacuagcuuccauagcauuuaaucacccuauacaaguagaccaacuaaacagcucauauuuuaaauuaucgauuccaacuaacuucucauuugguguuacgcaagaauacauccaaacaacuauucaaaaaguaacaguggacuguaaacaauacguaugcaacggauuucaaaaaugcgagcaacuucuaagagaauacggccaauuuugcagcaaaauaaaucaagcguuacauggugccaauuugcgacaagacgauucaguccgaaaucuauuugccagcguaaaauccucacaaucauccccuauuaucccggguuucggaggugauuuuaaucucacauuacucgaacccguaucaauuucaacugguucccguucagcacgcucggcuauagaagaccuacuguuugacaaaguaacaauagcagauccaggauauaugcaaggauacgacgacuguaugcaacaaggucccgcaucagcacgagaccuuauuugugcucaauacgucgcaggauacaaaguucuaccaccccuaauggaugugaauauggaagcagcuuauacuucaucacuauuagguucaauugcaggaguaggauggacugcugguuuauccucauuugcagcuaucccuuuugcucaaucuauauucuaucgacucaauggaguaggcaucacucaacaaguacuaucagaaaaucaaaaacucauagccaacaaauucaaccaagcucuuggagcaaugcaaacagguuuuacaacuacaaacgaggcuuucagaaaaguacaagaugcaguaaacaauaacgcgcaagcauuaaguaaacucgcaucagaacuuucaaacaccuuuggagccaucucugcaagcauaggggacaucauacaacgcuuggacguauuagaacaagacgcacaaauugaucgccuaauaaauggacgacucacaacucuaaacgcauuuguugcccaacaauuaguccgaagcgaauccgcugcacucagcgcucaacuagcaaaggauaaaguuaaugaaugugucaaagcucaaucuaaacgcucaggauuuugcggacaaggaacccacauuguuucuuuugucguaaaugcaccuaacggacuauauuuuaugcauguuggcuacuacccuucuaaucauauugaagugguaucugcauacggauuaugugaugcagcuaauccuaccaacuguauagccccuguaaauggauacuucauaaaaacaaauaacacacgcauaguugaugaauggaguuacacagguucgagcuuuuaugcuccagaaccaauuacuuccuuaaacacuaaauacguagcuccccaaguaacauaccaaaauauaucgacaaacuuacccccgccccuucuaggcaacagcacuggaauagacuuucaagaugaacucgacgaguucuuuaaaaacguuucgaccuccauuccuaacuuuggaucacuaacacagauaaauaccacacuuuuagauuuaacuuacgaaaugcucucacuacagcaaguuguaaaagcucuuaacgaaucauacaucgaccuaaaagaacugggaaacuauacauacuauaacaaauggcccugguauauauggcuuggauuuauagccggacuuguugccuuagcauuauguguguuuuucauauuguguuguacaggaugcgguaccaacuguaugggcaaacuuaaauguaaccgcuguugugacagauacgaagaauaugaccucgaaccucauaaaguucacguucauuaa

SEQ ID NO: 1127 - RNA, 4062 nt, Artificial Sequence
  derived and/or modified CDS sequence (opt6) from MERS-CoV__ALW82742__S
augauucauucaguuuuucuacuaauguuucuccuaacaccuacagaaucauacguggacguuggaccagauuccguaaaaagcgccuguaucgaagucgauauacaacaaacauucuuugacaaaacauggccacggccaauagacguuucaaaagccgaugguauuauuuauccccaaggccguacuuacaguaauauuacaauuacguaucaaggccucuuuccauaccaaggggaucacggagauauguacguauauucagccggccaugcuacaggaaccacuccccaaaaacucuuuguugcaaacuacucacaagauguaaagcaauucgccaacggauuuguuguaagaauaggagcugcagcaaauucaacaggaacagugauuauuucuccauccacaucugccacaauccagaaaauuuaccccgcauucaugcuugguuccucagugggcaacuucuccgauggaaaaauggggagauucuucaaucacacauuaguauuacuaccugauggcugcggcacauuacuaagagcuuucuauuguauacuagaaccaagaucaggcaaccacuguccugcaggaaacuccuauaccucauucgcaaccuaccacaccccugcaacagacugcuccgacgguaacuacaacagaaaugcaucccuuaauucauucaaagaauauuucaauuuaagaaacugcacauuuauguacacuuacaacauuacggaagaugaaauauuagaaugguucgguaucacgcaaacagcacaagguguccaccucuuuucuucccgauauguugaucuauacgggggaaacauguuccaauucgccacuuuaccagucuaugauacuaucaaauacuauagcauuauaccccauucaauccgaucaauacaaucagaucgaaaagccugggcagcuuuuuauguauauaaacuacaaccacucacauuucuccuggauuuuucaguugacggcuauauccgcagggcaauugacuguggauucaacgaccucucacaacuacauuguucuuaugaaucauuugauguagaaucaggaguuuauucuguuucaucauuugaggcaaaaccaucuggcagcguaguagaacaagcagaaggggucgaaugugacuucucaccccuauuauccggaacaccaccucaaguauacaauuuuaaaagguuaguauuuacuaauugcaacuacaaucugacaaaacuccucucccuauuuuccgucaaugauuucacuugcucucaaauaaguccagcugcuauugcuucuaauuguuacuccucauuaauacuagauuauuuuucuuacccacuaucaaugaaaucagaccucucuguuucgucagccgguccuauaucacaauuuaauuauaaacaaucuuuuaguaacccuacauguuuaaucuuagcgacaguaccacacaacuuaacaacgauaacaaagccacucaaauacucauacauuaauaaauguucccgucuauuaucagaugauagaacugaaguaccucaacuuguuaacgcaaaucaauacucuccuuguguauccaucguaccgucuacagucugggaggauggugacuauuaccgaaaacaauuaucaccacucgaaggaggagguuggcuaguagcauccggaucaacuguagccaugacagaacaacuacaaauggguuuuggcaucacuguccaauacggaacagauaccaauucuguaugccccaaauuagaauuugccaaugauaccaaaaucgccagucaauugggaaacuguguagaauauagccucuacggugucucagggcggggaguuuuucaaaacugcacagcaguuggaguucgccaacaacgauucguauacgacgcauaucaaaacuuagucggauauuauucugaugacgguaacuauuauugucuuagagcuuguguaucaguaccagucucugucauuuaugauaaagagacuaaaacccacgccacccucuucggaucaguagccugcgaacauauaucuucuaccaugucgcaauacuccagaucaacuaggucuaugcuaaaaaggagagacucuacauauggaccucuacagacuccuguaggauguguuuuaggauuaguaaacaguucacucuuuguagaagauugcaaacuaccacugggacaaucucugugcgcucucccugacacacccucuacacuaacccccagaaguguuaggucaguaccaggagaaaugagauuagcuucuauagccuucaaucauccaauacagguugaccaacuuaauaguucuuacuucaaauuaucuauaccaaccaacuuuucguucggagucacucaagaauauauccaaacaacaauucaaaaaguuacugucgauuguaaacaauauguuugcaacgguuuucaaaaaugcgaacaauuacuucgcgaauauggucaguucugcucaaaaaucaaccaagcauuacauggagcuaaucuaagacaggaugauucugucagaaaucucuucgcuucaguuaaaucuagucaauccucccccauaauuccaggguuugguggagauuuuaaucuaaccuuacuugaaccuguuucuaucucaacaggcucaagaucagcccgaucagcaauagaagauuuguuauuugacaaaguuaccaucgcugaccccggauauaugcaaggcuacgaugacuguaugcaacaaggaccagccagcgcuagagauuuaauaugugcccaauacguagcugguuauaaaguacuuccacccuuaauggacgucaauauggaagcagcauauacaucaucauuacuugguucuaucgcgggcgucggcuggacagcaggacuuucaucauuugcugcaauacccuuugcccaaucgauauucuaucgcuuaaauggaguaggaauaacacaacaaguuuuaagugaaaaccaaaaacucauagcuaauaaauuuaaucaagcccugggcgcaaugcaaaccgguuuuaccacaacuaaugaagccuuucguaaaguacaagaugcaguuaacaauaaugcacaagcacucucuaaauuagcuucagaauugagcaauacauuuggggccauuucagcaucaauaggugauauaauacaaagauuagauguucucgaacaagacgcgcagauagaucggcuuauuaauggaagacugacgacccuuaaugcuuucguagcccaacaguuaguccguucggaaucugcagcgcuuagugcccaauuagcgaaagacaaaguaaacgaauguguaaaagcucaaucuaaacgcucagguuucuguggacaagguacacacauaguaucauuuguagugaaugcaccaaacggauuauauuuuaugcauguaggcuauuacccaucaaaucauauagaaguuguuuccgcauacggucuaugcgaugccgcaaauccuacaaauuguauugccccaguuaacggauauuuuauuaaaaccaauaauacacgaaucguggaugaauggucauauaccggaucaucauucuaugcuccagaaccaaucacaucuuuaaacaccaaauacguagcaccucaaguaacauaccagaauauaucuacaaaucuuccuccuccuuuacuaggcaacucuacaggcauagacuuccaggaugaacuugacgaauuuuucaaaaacgucucgacuucaauaccuaacuuuggcagcuuaacccaaauaaacacuacauuacuagacuuaaccuacgaaauguuaucacuacaacaaguuguaaaagcucuuaaugaaucauauauagaucuuaaagaacuuggaaauuauacauauuauaauaaauggccuugguauaucuggcucgguuuuauagccggauuaguagcauuagcucuaugcgucuucuuuauccuauguuguacagguugcgguacaaacugcaugggcaaauuaaaauguaauagauguugcgaccguuacgaagaauacgaucuagaaccccauaaaguccacguacauuaa

SEQ ID NO: 1128 - RNA, 4062 nt, Artificial Sequence
  derived and/or modified CDS sequence (opt6) from MERS-CoV__ALW82753__S
augauucacucaguauuuuuacuaauguuucuacuaacuccaaccgaaucauaugucgauguuggaccugauuccguaaagucugcauguauagaaguagauauccaacaaacauucuuugacaaaacauggcccagaccuauagacguauccaaagcagacgggauaaucuauccccaagguagaacauacaguaauauaaccauuacuuaccaaggucuauuccccuaccaaggugaccauggagauauguauguauacucagcuggacaugcaacugguacuacaccacaaaaauuguucguagcaaacuacucacaagacguaaaacaauucgcaaacggcuuuguuguucgcauaggagcagcagcuaacucaacagguacaguaaucaucuccccaucaacaagcgccaccauucguaagauuuauccugcauucaugcuaggaaguuccguaggaaacuuuuccgaugguaaaaugggacgcuucuucaaucauacccuaguacuuuuaccagauggcuguggcacuuuauugagagcauuuuauuguauuuuagagccuagaucagguaaucauugcccugcaggaaauaguuacacgucuuuugccacauaccacaccccaucaacagacuguagugauggcaacuauaaccgcaaugcuagucuuaauucuuuuaaggaauauuuuaauuuaagaaacugcacauuuauguacacauauaacaucacagaagaugaaauacuagaaugguuuggaauuacucaaacagcucaaggcguucaucucuuuucuucacgauacgucgaucuauacggagguaacauguuucaauucgcaacucuuccuguuuaugauacaauaaaauacuacucaauuauaccucauucaauccgaucaauucaaucugauagaaaggcuugggcagccuuuuauguauacaaacuacaacccuuaacuuuccucuuagacuucucaguugauggauacauucgacgcgcaauugauuguggauucaacgaucuaucccaacuccauugcuccuaugaaaguuuugauguugaaagugguguauacuccgugucaaguuuugaagccaagccaucaggcucagucguagaacaagcagaggggguagaaugcgauuucaguccauuacuuucuggaacaccaccacaagucuacaauuuuaaaagacuuguuuucacaaauuguaauuacaauuuaacaaaauugcucucucuuuuuagugucaacgauuuuacauguucucaaauaucaccggcagcuauagcauccaauuguuauuccucccuaauacuagauuacuuuagcuacccacucucuaugaaaagcgaccuuucuguuucaucugcuggcccaauaucucaauuuaauuacaaacaaucauucucuaaccccacuugucucauucuagcaacagugccgcacaaucuaacaacuauaacaaaaccuuugaaauacucauacauaaacaaauguucgcgauuacuuucugaugauagaacagaaguaccucaacuuguuaaugcuaaucaauauucuccauguguaaguauaguuccaaguacagucugggaagauggagacuacuaucgaaaacaacuuuccccacuagaaggagguggcuggcuugucgccucugguucaacaguagccaugaccgaacaauuacagauggguuucgguauuacaguucaauacgguacugacacaaauuccguauguccaaaauuagaauuugcuaaugacacaaaaauagcuucucaacucggaaacugcguagaauacucgcuauacggagugucaggcagaggcguauuucaaaacuguacugcuguagguguuaggcaacaacguuuuguuuaugacgcuuaucagaauuuagucgguuacuacagugaugauggcaauuacuacuguuuaagagcaugcgucagcguuccaguaucaguaauuuaugacaaggaaacuaagacccacgcuaccuuauucgguucaguugcaugugagcacaucucaucuacgaugucacaauacucaagaucuaccagaagcaugcuaaagagaagagauuccacuuacgguccgcuucagacacccgucggauguguacuuggucuaguaaacucaucacuuuucgucgaagauugcaagcuaccacuaggccaaucauuaugugccuuaccagauacacccucaacacuaaccccucgcucaguacgaucagucccaggagaaaugagacuugcaucuauagcuuuuaaucacccaauccaaguuggacaacugaacaguuccuacuuuaaacuaaguauaccaaccaauuuuucuuuuggaguaacacaggaauacauccaaaccacuauacaaaaaguuacuguugacugcaaacaauauguuuguaaugguuuucaaaaaugugaacaacuacuacgagaauacggacaauuuugcucaaaaaucaaccaagcucuacauggagcuaauuuacgacaagacgacuccguucgaaauuuauuugcaucaguaaaauccucacaaucuucaccuauaaucccaggcuucggaggcgauuucaaucuuacccuguuagaacccguaucuauaucuaccgguaguagaucagcaagaucugcaaucgaagaccuuuuguuugacaaagucacgaucgcagauccuggguacaugcaaggauaugacgacuguaugcaacaaggcccagcaagcgcgcgagauuuaauaugugcucaguacguagcuggcuacaaaguccucccaccauuaauggacguuaauauggaagcugcguauaccucaucacuccuaggaucuaucgccggcguaggauggaccgcuggccugucaucuuucgcagcaauucccuuugcacaaucaauauucuaccgacuaaacggugucggaauaacacaacaaguacuaucagaaaaucaaaaacuuauagcaaauaaauucaaucaagcccucggcgccaugcaaaccggauuuacaacaaccaacgaagcauuuagaaaaguacaagaugcuguaaacaacaaugcccaagcauuaucaaaacuagcuucggaauuauccaacacguuuggagcuaucucagcaucuaucggugauauuauucaacgacuagauguacuugaacaagaugcccaaauagauagacugauuaacggccguuuaacaacauuaaaugcauucguagcacaacaauugguuagaucagaauccgcagcccucucagcccaacuagcaaaagacaaagucaaugaaugugucaaagcacaaagcaaacgaaguggauuuuguggacagggcacccacauaguuagcuuuguuguuaacgcaccaaacggauuauacuuuaugcauguuggauauuauccaucaaaccauauagaagucgucucugcauauggacuaugugacgcugcuaauccaacaaauugcauugcaccaguaaacggauauuuuauaaaaacaaacaauaccagaauuguagacgaauggucguauacuggaagcucauuuuaugcaccagaaccaauuacauccuuaaacacuaaauauguugcuccgcaaguaaccuaccaaaauauaucuacaaaccugccaccaccuuugcucucaaauaguaccgggaucgauuuccaagaugaauuggaugaauuuuucaaaaacguaucaacaucuauacccaauuucgguucacuaacccaaauaaauaccacacuacuugaccuaacuuaugaaaugcuaucucuccaacaaguaguaaaagcacucaaugaauccuauaucgaucuuaaagaacucggaaacuacacuuauuauaauaaauggccaugguacaucugguuagguuuuauugcaggacugguagcccucgcucuauguguuuucuuuauacucugcuguacaggauguggaacuaacugcaugggcaagcucaaauguaaucgauguugcgauagauacgaggaauaugauuuagaaccacacaaaguucauguucauuaa

SEQ ID NO: 1129 - RNA, 4062 nt, Artificial Sequence
  derived and/or modified CDS sequence (opt6) from MERS-CoV__ALX27228__S
augauucacuccguauuucuccuaauguuuuuacugaccccaacagaaucuuauguagauguuggaccagauucagugaaaucagcaugcauagaaguugacauacaacaaacauuuuucgacaaaaccuggccaagacccauagacguaucuaaagccgacgguauaauauauccgcagggacggaccuacucaaauauaacuaucacauaucaaggacuauuuccauaccaaggcgaucauggagacauguacgucuauucggcuggucacgcaacagguacuacaccucaaaaauuauuuguugcaaauuacucacaagacguaaaacaauuugcaaaugguuucguaguccgaauuggagcagcugccaacagcacaggaacuguuauaauuucaccauccacuucagcaacgauacggaaaaucuauccagcauucaugcuaggaagcucuguagguaacuucucugacggcaaaaugggaagauucuucaaucacacguuaguacuacuucccgauggcugugguacacuacuccgcgcauucuauugcauucucgaaccaagaucuggaaaccauugccccgcaggaaacucguacaccucuuucgcuacuuaucacacccccgccacagauugcagugacggaaauuauaauagaaaugcgucauugaacucuuuuaaagaauacuucaaccuaagaaacuguacauucauguauaccuauaauauaacagaagacgaaauacucgaaugguucggaauaacacaaaccgcacaaggaguucaucucuucagcucccguuauguugaucuuuacggcggcaauauguuucaauucgcgacauuacccguguacgauacuauuaaauacuauuccaucauaccacauuccauaagaucaauacaauccgauagaaaagccugggcagcuuuuuacgucuacaaauuacaaccacucacuuuucuacucgacuucuccguagacggauauauaagacgagcaauagauugcgguuucaaugacuuaucucaacuccauugcucuuacgaaucauucgaugucgaaucaggugucuauucugucucaaguuuugaagcaaaaccuagcgggucaguaguagaacaagccgaaggggucgaaugugacuucucuccauuacuuucagguacaccuccacaagucuauaacuucaaacgcuugguauucacaaacugcaacuauaacuuaaccaaacuacuuagccuuuucagcgucaacgauuuuacaugcagucaaauaaguccagcagccaucgcaucaaacugcuacuccucacuaauacuugauuauuuuucuuacccacuuuccaugaaaagugaccuauccguaaguucagcuggcccaauuucgcaauuuaauuacaaacaaucauucuccaacccaaccugucuaauauuagccacaguaccacacaacuuaacuacuauaaccaaaccauugaaauauucauacauaaauaaguguucccgacucuuaucagaugauagaacagaaguaccccagcuaguuaacgcaaaccaauauucaccuuguguaucuaucguaccaucaacugucuggaaagacggugauuacuaccgaaaacaauuauccccacuagaagguggaggauggcuagucgcaucaggguccaccgucgcuaugacggaacaacuucaaaugggauucggaauaacuguacaauacggaacagauacuaauucugucugucccaaacuagaauuugccaaugauacaaaaaucgcaucacaauuaggaaauugcgucgaguauuccuuguauggaguuucaggacgagguguauuucaaaauugcacagccgucgggguacgucaacagcgcuucgucuaugaugcauaucaaaaucuaguagguuauuacuccgaugacgguaauuacuacugucucagagccuguguaucaguuccaguaucugugauauacgauaaagaaacaaaaacacaugcuacauuauuugguaguguugcaugcgaacacauaagcuccacuaugucacaauauucaagaucuaccagaucgauguuaaaaagacgugauucaacuuacggaccucuacaaacaccuguaaguugcguuuuagggcuaguuaacagcucauuauucguugaagacuguaaguuaccacuaggacaaagucuaugugcccuccccgauacaccuucuacucuaacaccucguucaguaaggucuguaccuggugaaaugagauuagcaucaauagcuuuuaaucacccuauacaaguugaccaauuaaauuccucauacuucaagcuauccauaccgacaaacuuuagcuucggcgucacacaagaauauauacagacgacgauccaaaaaguaacaguugacuguaaacaauauguuuguaauggauuucaaaaaugugaacaauugcucagagaauauggacaauuuuguucaaaaauaaaucaagcucuacauggugcaaaucuacgacaagaugauuccguaagaaauuuauucgcaucaguaaaaaguucucaaucuagcccaauaaucccagguuuuggaggagauuucaaucucacacuauuggaacccguuucgauauccacaggaaguagaucugcuagaucagcaaucgaagauuuacuauuugauaaaguaacgauagcagacccaggauacaugcaagguuacgaugacuguaugcaacaagggccugcaucagcaagagaucuaauuugugcucaauauguagcaggcuacaaaguauuaccuccuuuaauggacgucaauauggaagccgcuuauacuagcucacuucuugguucaauagcaggcguugguuggacugcgggcuuauccucuuuugcagccauaccauuugcucaaucaauuuucuauagauuaaacggagucggcauaacacaacaaguacuaucugaaaaccaaaaacuaauagcaaacaaauucaaucaagcauuaggugcuaugcaaacggguuucacuacaacaaaugaagccuuucgcaaaguucaagacgcaguaaacaauaacgcccaagcauuaucaaaauuagccuccgaauuaaguaauacuuuuggcgccauaucagcaucaauaggagauauaauucaacgccuagacguauuagaacaagacgcucagauugacagauuaauuaauggaagacucacaacccuaaaugcauucguagcacaacaacucguccggucagaauccgccgcccuuucugcucaauuggcuaaagauaaagucaacgaaugcguaaaagcccagucgaagagaagcggcuuuuguggucaagguacacacauagugucuuucguuguaaacgcaccgaauggccuuuauuuuaugcauguugguuacuaucccucaaaccacauagaggugguaucugcauacggucuaugugacgcagcaaacccuacaaauuguauagcuccaguaaaugguuacuuuauaaaaacuaauaacacacguauaguagaugaauggaguuacacuggcaguagcuuuuaugcacccgaaccuauaacuagcuuaaauacaaaauacgucgcaccccaaguuacauaucaaaacauaagcaccaaucuucccccaccccuucuaggaaacucgaccggaauugacuuccaagacgaacuagacgaguucuuuaaaaacgucucuacaucaauuccaaacuucgguucacuaacacaaaucaauacaacacuauuagacuuaaccuacgaaaugcuaucuuuacaacaaguaguuaaggcauugaacgaaagcuauauagacuuaaaagaacuaggaaacuacacuuacuacaauaaauggcccugguauauauggcuaggcuuuauugcgggucuaguugcccucgcacuaugcguauucuuuauacuaugcuguacagguugcggcaccaauugcaugggaaaauuaaaguguaaccgauguugcgaucgauaugaagaauaugacuuagagccccauaaaguacacgugcacuaa

SEQ ID NO: 1130 - RNA, 4062 nt, Artificial Sequence
  derived and/or modified CDS sequence (opt6) from MERS-CoV__ALX27232__S
augauacacucuguuuuucuccuaauguuuuuacuaacaccaacugagucuuauguagauguugggcccgacuccguaaaaucugccuguauagaaguagacauucaacaaacuuucuuugauaaaaccuggccacgccccauagacgucuccaaagcagaugguauaauuuauccgcaaggaagaaccuauaguaacauaacuaucaccuaccaaggacuauuuccuuaccaaggcgaucacggagacauguacguauauuccgcaggucaugcaacaggaacuacaccccaaaaacuauucguagccaauuauucucaagacguaaaacaauucgcaaauggauucguaguccguauaggugcugcugccaauuccaccggaacugugauaauaaguccaucaaccagcgccacaauaaggaaaauauacccagcauuuaugcuugguucaagugucgguaauuucaguuauggcaaaaugggccgauuuuucaaucacacgcuaguucuauuacccgacgguugcggaacacuccuucgggcauucuacuguauauuagagccacgaucugguaaucacugcccugcaggaaacucuuacacaucauuugcuacauaccacaccccugcaacagauuguucugaugguaauuauaacagaaaugccucauuaaacaguuucaaggaauacuuuaauuuaagaaacugcacauuuauguacacauacaacauaacugaagacgaaauacucgaaugguuuggaauaacucaaacugcacagggaguacaucuauuuaguucucgauauguugaucuauauggaggcaauauguuucaauucgcaacucuaccaguuuaugauacaauuaaauacuauucaauaauaccacauucaauacgcaguauccaauccgauagaaaagcaugggcagcauuuuacguauauaagcuacaaccucuaaccuuucuacuugauuuuaguguagacggauauauaagacgggcaauagacugcggauuuaaugaucuuucccaacuacauuguuccuacgaauccuucgacguugaaucaggcguuuauucuguaagcucauuugaggcaaaaccaucaggauccguaguugaacaagcugaaggagucgaaugugauuuuucuccucuucuuagcgggacgccuccacaaguauauaacuuuaaacgcuuaguuuuuacuaauugcaacuacaaucuaaccaagcuccucucccuauucagugugaaugacuucacauguucucaaauuucaccagcagccauugcaucaaacugcuacucaucucuaauauuagacuauuuuuccuauccacucucuaugaaaucugauuuaucaguuucaucagcugguccaauaucacaguuuaauuauaaacaaucauucagcaauccuacauguuuaauucuagcaaccguaccccauaaucuuacaacuaucacaaaaccauuaaaauauucauauaucaacaaauguaguagauuacucagugacgaccgcacagaagucccacagcuaguuaaugcuaaccaauauucacccugugucucaaucguaccuucuacaguaugggaagauggggacuacuauagaaaacaauuaucaccauuggaagguggcggaugguuaguagcuagcggcucuacaguagcaaugacagaacaacugcaaaugggauucgguauaacuguacaauacggaacugauacaaauucaguuugucccaaauuggaauuugcgaaugacacaaaaaucgccucacaauuaggaaacuguguugaauacucccucuauggagucucuggaagaggcgucuuucaaaacugcacagcuguaggaguacgacaacaaagauuuguauacgaugcuuaucaaaacuuaguuggauacuauucagaugauggaaauuacuacuguuuaagagccugugucagcguuccaguaucaguaauauacgauaaagaaacaaagacacacgccacuuuauuugguaguguagcaugcgagcauaucucauccacaaugagccaauacucucgcucuacucgaucaauguuaaaacgucgugauuccacauaugguccuuuacaaacaccagucggaugcguacucggauuaguuaacucaucacuauucguagaagacuguaaacuaccucuaggacaaucacuaugcgcacuccccgacacaccaucuacuuuaacgccccgauccguccguucuguacccggagaaaugcgauuagccaguauagcuuuuaaucauccgauccaagucgaucaacugaauaguuccuacuuuaaacuaucuauccccacaaacuuuucauuugguguuacucaagaauauauucaaacuacuauccaaaaaguaaccguugacuguaaacaauacguauguaacggcuuucaaaaaugugaacaauuauuacgcgaauacggccaauucugcucaaaaauaaaccaagcccuacacggagcaaauuuaagacaagacgacaguguuagaaaccuauuugccucaguaaaaucaucacaaucgucacccauuauaccaggauuugguggagauuuuaauuuaacccucuuagaaccuguaucaaucagcaccgguucacgaucagcaagaagcgcuauugaagacuuacuauuugauaaaguaacaauugcagaccccggauacaugcaaggcuacgaugauuguaugcaacaaggacccgcaucagcccgagaucuuauaugugcacaauauguugcaggauauaaaguucuaccuccccucauggauguuaauauggaggccgccuauacuucaucucuucugggcucaauagcaggaguaggcuggacugcaggguuaucaucauuugccgcuauccccuuugcucaaucuauauucuaccguuuaaauggaguuggaauaacacaacaaguauuaucagaaaaucaaaaauuaauagcaaacaaauuuaaucaagcacuaggugcaaugcaaaccggauucacuaccacaaacgaagcguuucgaaaagugcaagacgcaguaaacaauaaugcacaagcauugucaaaacuugcgucagaacuauccaacacauucggagcuauaucugcaucgauaggugacauaauacaacgauuagacguauuagaacaggaugcacaaaucgaccgccuaauaaaugggagacucacaacauuaaaugcguuugucgcucagcaacuugucagaagugaaagugcagcucuaucagcucaacuagcuaaagacaaaguaaaugaaugugucaaagcacaaucaaaacgaucuggauucugcggucaagguacucacauaguuuccuuuguuguaaacgcaccuaauggcuuauacuuuaugcauguaggcuacuacccauccaaccacauagacguaguuuccgcauauggauuaugugacgccgcgaaccccaccaauugcauugcaccaguuaauggauauuuuauaaaaacaaauaauacacguauugucgaugaauggucauauacugguuccucuuucuacgccccagaaccuaucacaucacucaacacaaaauacguugcaccucaaguaacuuaccagaauauaucaacaaaucuaccaccuccccucuuaggcaauaguacgggcauugauuuucaggaugaacuagacgaguucuucaaaaauguaucaacaagcauucccaacuucggaucauuaacucagauuaacacaacucuuuuagaccuaacauaugaaauguuaucccuacaacaaguuguaaaagcauugaaugaauccuauaucgaucuuaaagaauuaggaaacuauacauauuauaacaaauggcccugguauauaugguugggcuuuauugccggauuaguagcuuuagccuuauguguauucuucauucucugcuguacuggcugugguaccaauuguaugggcaaacuaaaaugcaacagauguugugaccgcuacgaagaauaugaucuugaaccacacaaaguucacguacacuaa

SEQ ID NO: 1131 - RNA, 4062 nt, Artificial Sequence
  derived and/or modified CDS sequence (opt6) from MERS-CoV__AMQ48993__S
augauacauuccguuuuucuucuaauguucuuauuaacaccaacugaaucauaugucgaugucggacccgauucaguaaaaucagccugcauugaagucgacauacaacaaacuuucuucgacaaaaccuggccaagaccuauagacguauccaaagcagaugggaucauauacccccaaggucgcacauauuccaauauaaccauuaccuaccaaggucuuuuuccauaccagggcgaucauggcgacauguacguauauucagccggccaugcaacaggaacuacaccucagaaacuguuuguugccaauuauucacaagacguaaagcaauuugcuaacggauucguaguuagaauaggagcugcugccaacucuacuggaacaguaauaaucucaccauccacuagcgccacaauccgaaaaauauauccagcauuuaugcucggaucaagcguagggaauuuuucugacggaaaaauggguagauucuuuaaucauacucuaguacuacuaccagaugguuguggcacauuauuacgagcuuuuuacugcauucuagagccucgcucugguaaccauugcccugccgggaacaguuauacauccuuugccacauaccauacuccugccacagauugcagcgauggaaacuacaacagaaaugcaucauuaaauucauuuaaagaauauuuuaacuuacgaaacuguaccuuuauguauaccuauaacauuacagaagaugaaauucucgaaugguuuggcaucacacaaacagcacaaggaguacaccuauucucgucacgcuauguugacuuauauggcggaaauauguuccaauuugcaacuuuaccaguauacgauacaauuaaauauuacucaaucauuccacauaguauaagauccauacaaagcgacagaaaagccugggccgcuuucuacguuuacaaacuccaaccucucaccuuucuauuagacuuuucugucgaugguuauauacgccgagcuauugauuguggcuuuaaugacuuaagucaacuucauugcucauacgaaucauuugacguagaaucggguguuuauucuguuucaaguuucgaagcuaaaccgucaggaucaguaguagagcaggcugaggguguugaaugcgauuucucuccucuccucagcggaacuccaccacaaguauauaacuucaaaaggcucguuuuuacaaacuguaacuauaaucucacuaaacuuuuaucccuauuuucaguaaaugacuuuacaugcucacaaauauccccagcugcaauugccucuaauuguuauuccucucuaauuuuagauuauuuuucuuauccauuaucuaugaaauccgacuuauccgucagcagugccggcccuauuucacaauuuaauuauaagcagagcuuuucuaacccuacaugccucauccuagcaaccguuccacacaacuuaaccacuauaaccaaaccauuaaaauauaguuauauaaacaagugcucaagacuacuauccgacgaucgcacagaagugccacaauuagugaaugcaaaucaauauucgcccuguguuucaauaguucccuccacugugugggaagacggagacuacuacaggaaacaauuaucaccacucgaagguggcggaugguuaguagcuuccgggucaauagucgcaaugacugaacaauuacaaaugggauucggcaucaccguacaauacggcaccgauaccaauaguguaugcccuaaacuggaguucgcuaaugacacaaaaauagcaucacaauuaggaaauuguguugaauacucacuauaugguguaucaggacgaggcguauuucaaaauuguacagcaguaggaguuagacaacaacgauuuguauaugaugcauaccaaaauuuaguaggcuacuauagugaugacggaaacuauuacugucuaagagccuguguuucuguacccguaucugucaucuacgacaaagaaacuaaaacucacgccacacuauuuggcucuguagcaugcgaacacauaucaucuaccaugucacaauacucccgaucgacaagaucuauguuaaaacgccgcgauaguacuuacggcccacuacaaaccccgguugguuguguacuaggucuaguaaacucaagucuauuuguagaagauuguaaacuaccucuaggacaaucucuaugugcguuaccggacacucccagcaccuugacuccaagauccguucguucagucccaggagaaaugcgauuagcaucaauagcguucaaccaucccauacaagucgaccaacuaaacucuucauauuuuaaacuauccaucccaacuaacuuuuccuucggagucacucaagaauacauacaaacuaccauacaaaaaguaaccguugauuguaaacaauacguuuguaaugguuuucaaaaaugugaacaacuacuacgagaauauggucaauuuugcuccaaaauaaaccaagcccuucauggcgcaaauuuaaggcaagaugacucaguuagaaauuuauucgccucuguaaaauccucacaauccaguccaauaauucccgguuuugguggugacuuuaauuuaacucuccuugaaccagucucuauaucuacaggcucacgaucagcacggucugcaauugaagauuuacuuuuugauaaaguuacuaucgccgauccagguuacaugcaagguuacgaugauugcaugcaacaagggccugcgagugcuagagauuugauaugugcacaguauguagccggauacaaaguucuaccgccacuaauggauguaaacauggaagcugccuacaccagcucccuacuaggaucuauagcugguguaggcuggaccgcaggacucucaucauucgcagcuauuccauuugcgcaauccauauucuacagauuaaauggggucggaaucacucaacagguauuaagugaaaaucaaaaacuaauugcgaacaaauucaaucaagcauuaggugcuaugcaaacaggauuuacaacaacaaacgaagccuuccgaaaaguacaagaugcagucaacaauaaugcacaagcacuuucaaaauuagcaagugaacuuuccaauacauucggugccaucucugcuagcauuggagacauaauacaaagacuagaugucuuagaacaagaugcacaaauagauagacuuauuaaugguagacucacaacucuuaaugcauuuguugcacaacaauuaguucguagugaaucggcagcuuuaagcgcacaacuugcaaaagauaaaguaaaugaauguguaaaagcacaaaguaaaagaucuggauucugcggucaagguacccacauaguuaguuuuguaguuaaugcaccaaauggacuguauuuuaugcaugucgguuauuaucccucgaaucauaucgaaguuguuagcgcauauggacucugugacgcugcuaaucccacaaacugcauaacaccagugaacggauacuuuauuaaaacuaacaacacaagaauuguagaugaauggucauacaccggauccucauuuuaugcacccgaaccaaucacuagcuuaaauacaaaauauguugccccacaaguaacauaucaaaauauuucaacuaaucugccaccuccucuacuuucuaauucaaccggaauagauuuccaagaugaauuagaugaguuuuucaaaaaugucaguacgucgauaccaaauuucgguucauuaacucaaauaaauacaacauuacucgaccuuacauaugaaauguuaagccuucaacaaguagucaaagcccuuaacgaaagcuauauagaucuaaaagaacuagguaauuacaccuacuauaacaaauggccaugguauauauggcuaggauuuauagcaggacuuguagcauuagcguuaugugucuucuucauacuuuguuguacagguuguggaacaaauugcaugggaaaacuaaaaugcaaucgcugcugcgauagauacgaagaauacgaucucgaaccacauaaaguacacguacacuaa

SEQ ID NO: 1132 - RNA, 4062 nt, Artificial Sequence
  derived and/or modified CDS sequence (opt6) from MERS-CoV__AMW90844__S
augauccauucaguauuuuuacuuauguuuuuacuaacaccuaccgaaucuuauguagaugucggucccgacucgguuaaaagugcuuguauagaagucgauauucagcagaccuuuuucgauaaaacauggccccguccuauagacguaucuaaggcugauggaaucaucuacccccaaggcagaaccuauucuaauauaacaauaaccuaccaaggccuuuuucccuaccagggcgaucacggugacauguacguguacuccgcaggccacgcaacuggaacuacuccacaaaaauuauuuguagcaaacuauucacaagacgugaaacaauucgcgaacggauucgucguuagaauuggugcagcagcaaacuccaccggaacuguaaucauauccccaucaacaucagccacuauucgaaaaauuuacccugcauuuaugcuaggcucauccguagguaacuucagugauggaaaaauggguagauucuuuaaccacacccuagugcuuuugccagacgguugcggaacauuacuaagagcauuuuacuguauuuuagaaccucgaucaggcaaucacuguccagccggaaauaguuauacaucuuuugcuacauaccacacccccgccaccgacugcucagaugguaauuauaauagaaacgcgagucuaaauuccuucaaagaauacuucaauuuacguaauugcacauuuauguacacuuauaacaucacagaagacgaaauuuuagaaugguucgggauuacccaaacagcucaaggaguacacuuauuuucaaguagauacguagaucuuuauggaggcaauauguuucaauuugcuacucuuccuguauaugacacuauuaaauacuacucaauaauaccacauaguauccgaucaauucaauccgaucguaaagcaugggccgcguucuacguauacaaacuccaaccacuaacuuuucuacuagacuuuucuguagacggauauauacgucgugcaauagauugugguuuuaacgaccuaucgcaacuacacuguucguaugaaucauuugacguagagagcggaguauauuccguuucaucauucgaagcaaaacccagcggaucaguaguugagcaagcagaaggugucgaaugugacuucagucccuuauugucaggaacuccuccacaagucuauaacuucaaaagacucgucuuuacuaauuguaacuauaaccucaccaaacuauuaucccuauuuucuguuaaugauuuuacuugcucacaaauaucuccagccgcaauugcaucaaauuguuauuccucauuaauacucgauuacuuuucauacccacuuucuaugaaaucagaccugucuguaucaucugcaggaccaauuagucaauuuaauuacaagcaaucuuucuccaacccuacuugcuuaauacuugcuacagugccacacaauuuaacgacaauaacaaaaccauuaaaauauucuuacaucaacaaauguucucgucuacuaagcgacgacagaaccgaagucccccagcuaguuaacgcaaaccaauauucuccaugcguaucaaucgugccuucaaccguuugggaagauggagacuauuauagaaaacaacuaagcccauuagaagguggaggauggcuaguagcauccgguaguacaguagcaaugacagaacaacuucaaaugggauuuggaauuacauuucaauauggaaccgauacaaacuccguuugccccaaauuagaauuugccaaugauaccaaaaucgcaucacaacucgggaauugcguugaguauucccuauacggagucuccggcagaggcgucuuccaaaacugcaccgcgguuggagucagacaacaacgauuuguauaugaugcauaucaaaaucuaguugguuauuacuccgaugacggaaacuauuauugucuaagagcaugcguauccgucccgguauccgugauuuaugauaaagaaacuaagacucacgccacacuuuuuggaucaguagcuugcgaacauaucucaaguacaaugucacaauauucgcguucaacuagaucaaugcuuaaaagacgcgacucaacauauggcccauuacaaaccccugucgguugcguacuaggauuggucaauucuagucucuuuguugaagacuguaaacuuccccucggacagagccuaugugcccuacccgauacuccaucaacacuuacuccacggucaguuagaucagugccaggcgaaaugagauuagcaucaauugccuucaaucaucccauacaaguagaccaacucaacaguuccuacuuuaagcuaaguauaccaacuaacuuuucauuuggcguuacacaagaauauauucaaacuacaauacaaaaaguuaccguugacuguaaacaguauguaugcaacggcuuucaaaaaugugaacaauuauuaagagaauacggacaauuuugcuccaaaauaaaucaagcacuucauggagcuaaccuccggcaagacgauucgguucguaaucuguuugcaucaguuaaaucaucacaaucauccccaauaauuccaggguuuggaggcgauuuuaacuuaacacuacucgaaccaguuagcauaaguacuggcuccagauccgcccgcucagcuauagaagaccuauuauuugacaaaguuacuauagcggacccuggauauaugcaaggauacgaugauuguaugcaacaaggacccgcaucagcucgugaucuaauaugugcucaauacguugcagguuacaaaguucuuccaccucugauggacguuaauauggaagcagcauauacuucaucacuacuuggcucaauugcaggaguagguuggaccgcugguuuaucauccuucgcugccauaccauuugcccagucuauauuuuaucgacuaaacggggucgguauaacccaacaagucuuaagugaaaaucaaaaacuaauagcaaacaaauucaaucaagcacuuggagcaaugcagacaggcuucacgacaaccaaugaagcauuucguaaaguacaagaugcaguaaauaauaacgcacaagcucucucuaaauuagcuuccgaacucaguaauaccuuuggcgcuauaucagccucaauuggagacauuauacaaagguuagacguauuagaacaagaugcucaaauagaccgauuaauuaacggcagauuaacaacauuaaacgccuucguugcccaacagcuagucagauccgaauccgcugcauuaucagcgcaacucgcuaaggauaagguaaacgaauguguaaaagcccaauccaaaagaagcggcuuuugcggccaaggaacgcacaucguaucuuucguuguuaaugccccaaacggauuauacuuuaugcaugucggauauuacccgucuaaucacauagaagugguuucugcauauggacuaugugaugcggcuaaucccaccaauugcauagcaccugugaauggauacuucauaaaaacuaacaauacaagaauuguagaugagugguccuacacagguagcucguuuuaugcaccagaaccuauaacuucucuaaacacuaaauaugucgcaccacaagucacauaucaaaacauaucaaccaaucuuccuccaccacuucuaggaaauucaacaggaauagacuuccaagaugaacucgaugaauuuuucaaaaacguuuccacuucaauaccaaauuuugguucacuaacccaaaucaauacaacauuauuagauuuaacauacgaaaugcuuaguuuacaacagguagucaaagccuuaaaugaguccuauauugaccucaaagaauuagguaacuacacuuacuacaacaaauggccuugguacauauggcuaggcuuuauagccggacuuguagcgcuagcacuaugcguuuucuuuauuuuauguugcacuggauguggcacaaacuguauggguaaacucaaauguaaucguugcugcgauagauacgaagaguaugauuuagaaccucauaaaguacauguccacuaa

SEQ ID NO: 1133 - RNA, 4062 nt, Artificial Sequence
  derived and/or modified CDS sequence (opt6) from MERS-CoV__AMW90852__S
augauucauucuguguuuuuauuaauguuucuguuaacccccaccgaaucauauguagacguaggacccgauuccguuaagucagcauguauagaaguugauauacaacaaacauucuuugauaaaacuuggccucgaccuauugacgucucaaaagcagauggcauuauauauccucaaggucgcaccuacagcaauauaacaauaacuuaucagggacuuuucccuuaucaaggcgaccauggagacauguauguauauucugcagggcaugcuacagguacaacaccucaaaaauuauucguagccaauuacucccaggacguaaaacaauucgcuaauggcuuuguaguacguauuggagcugcagcaaacucuacaggaacaguaaucauaucaccaucaaccagcgcaacaauccgcaaaaucuauccagcauucauguuaggcuccaguguuggaaauuuuucagacggaaaaauggguagauucuuuaaccacacacucguacuucuaccagauggcugcggaaccuuacuucgagcuuucuauuguauauuagaaccaagaucuggaaaucauugcccagcaggcaauaguuacacaucauuugcuaccuaucacaccccagcaacagacugcuccgacgguaauuacaaucgaaaugcaagucuaaauaguuucaaagaauacuuuaaccuacguaauugcacguucauguauacauauaauauaacagaagaugaaauacuugaaugguuuggcauaacccaaacagcccaaggaguccaucucuuuuccucccguuacguagaucuuuauggcggaaauauguuucaauuugcuacuuugccuguauaugacacuaucaaauauuacuccauaauuccgcauucgauacgaucaauacaauccgacagaaaagcaugggcagcauucuaugucuauaaacuccaaccacuaacguuuuuauuagauuucaguguagacggcuacauuagacgagccauugacugcgguuucaaugauuuaagccaauuacacuguucuuacgaaucauuugacguagaauccggagucuauucugugucuucuuuugaagccaaaccaagcggaucagucguagaacaagcugaaggagucgaaugcgacuuuucaccucuauuaucuggaacaccaccucaaguauacaauuuuaaacgacuuguauuuacaaauugcaauuauaacuucacaaaauuguuaucucucuucucuguaaacgauuuuacaugcucucaaauuucucccgccgcaauagcaucaaacugcuauaguucucucauauuagauuacuucucauacccauuaaguaugaaaucggaucuaucuguauccucagcaggaccuauuagccaauucaacuacaaacaaucauucucgaauccaacauguuuaauacuagcaacaguaccucauaaccuaacaacaauaacaaaaccccucaaauauucauauaucaauaaauguucucgacuuuuaucagaugaucgcacagaaguaccacagcuaguuaaugccaaucaauacucaccaugcguaaguauaguaccuucaacaguaugggaagacggugacuacuaccguaaacaacucucaccucuagaagguggcggauggcugguagcgucaggaucuacuguagcaaugaccgaacaacuucaaaugggcuucggaaucacaguacaauacggcacagacacuaauucaguauguccaaaacuagaauuugcaaaugacacuaaaauugccucacaacuagggaacugcgucgaauauucauuguacggaguuucuggacgcggaguguuccaaaauuguacagcagucggagucagacaacaaagauucgucuaugacgcuuaccagaaccuuguuggcuauuauuccgacgacggcaauuacuauuguuuacgugcuuguguaucagucccaguaucuguaauauaugauaaagaaacaaaaacacaugcgacauuauuuggcucaguugcuugugaacauauuucaucaaccaugucucaauacucucgauccaccagaucuaugcuaaaacgcagagacagcacguacgguccauuacaaacaccaguugguuguguauuaggacuugucaauucgucacuguucgucgaagacugcaaacucccuuugggccaaucucuaugugcacuacccgauacccccagcacauuaacuccaagaaguguucgauccguccccggcgaaaugagauuagcuucaauagcauuuaaucauccaauacaaguggaucaauuaaauucaucauacuuuaaauuauccauaccuacaaauuucucauuuggaguaacacaagaauauauacaaacuacaauacaaaaagucacugucgacugcaaacaauacgucuguaacggauuucaaaaaugugaacaauuacuacgagaauacggucaauucuguucaaagaucaaucaagcauugcacggagcaaaucuacgacaagacgauucagucagaaaucuguuugcaucaguaaaaucgucucaaucaucuccaauuaucccggguuuuggcggagauuucaaccuuacucuacuugaaccagucuccauauccacaggaucucgauccgcacguagcgcaauugaagaucuauuauucgauaagguaacgaucgccgacccugguuacaugcaaggauacgacgacugcaugcaacaagguccggcaagugcucgagaucuuauuugcgcucaauaugucgcagguuacaaaguacucccuccacuaauggacguuaauauggaagcugcauauacaucaucuuuauuaggcaguauagcaggcguagguuggacagcuggccucucuucauuugcagccaucccuuucgcucaaucaauuuucuauagauuaaacggaguuggaauuacccaacagguacuaucagaaaaucaaaaacuuaucgccaacaaauucaaccaagcauuaggcgcaaugcaaacagguuucacaacaacaaacgaggcauuuagaaaaguacaagacgccguaaauaauaaugcacaagcauuaucuaaacuagcuucagaauuauccaauacuuuuggugcuauuuccgccaguauaggagauaucauacaacgacucgacgugcuugagcaagacgcacagauagauagauuaauaaacggaagacuaacaacacuuaaugcauuugucgcacaacaacuuguccgcuccgaauccgcagccuuaucugcacaauuagcuaaagauaaaguaaaugaauguguaaaggcucaaucaaaacggucaggauucugcggacaaggaacccauauaguaucauuuguuguaaacgccccuaauggucuguacuuuaugcauguuggguacuauccaucuaaucacauugaagucgucuccgccuauggauuaugugaugcugcgaacccaacaaacugcauagcuccagucaauggauauuuuauuaagacaaauaauacuagaauugucgacgaauggucauauaccggcucaucauuuuaugccccagaaccaauaaccucacuuaauaccaaauauguagcaccgcaaguuacuuaccaaaauauaaguacaaaucuacccccgccauugcucggaaauuccacaggaaucgauuuccaagaugaauuagaugacuucuuuaaaaaugucucaacuucaauacccaauuuuggcucuuugacacaaauaaauacgacucuauuagaucuaaccuacgagauguuaucacuucagcaagugguuaaagcacuaaaugaaucauauaucgacuuaaaagagcuagguaauuacacauacuacaauaaauggccuugguacauuugguuaggauuuauagccggccuaguagcuuuagcguuaugugucuucuuuauacuuuguuguacaggaugcggcacuaauugcaugggcaaacucaaauguaaucgauguugugacagauaugaagaauaugacuuagaaccacauaaaguacacguacacuaa

SEQ ID NO: 1134 - RNA, 4062 nt, Artificial Sequence
  derived and/or modified CDS sequence (opt6) from MERS-CoV__AMW90853__S
augauacacucaguuuuucuacuaauguuucugcucacuccuacagaaucauauguagaugugggcuccgacucaguuaaaucggcuuguauagaaguugauauacaacaaacuuucuuugacaaaaccuggccucguccaauagaugucucuaaagccgauggaauaauauacccccaaggcagaacauauucaaacauuacuauuacauaccaaggacuauuuccauaucaaggagaucacggugauauguacguauauucagcuggauaugcuacagguacuacaccacaaaaacuuuucguagcaaauuacucucaagauguaaaacaguucgcaaacgguuuuguaguaagaaucggcgcagcagcaaauucaacaggaaccgucauuaucucucccaguacaucugcaacuauuagaaaaaucuaucccgccuuuaugcuaggaucuaguguaggcaacuucucagacgguaaaaugggaagauuuuucaaccauacgcuuguacuuuuaccagauggauguggaacacuacuaagagcauuuuauuguauacuagaaccacguucaggaaaccacugccccgccgguaauuccuacacuuccuucgccacauaucauacaccagcaacagauugcucagauggcaauuacaauagaaaugccuccuuaaauucuuuuaaagaauacuuuaaucuacggaauuguacauuuauguacacauacaacaucaccgaagaugaaauauuggaaugguucggaauuacucaaacagcacaaggaguucaccuauucaguucacgcuauguggaucuuuaugguggcaacauguuucaauucgcaacucuaccaguauaugacacuauuaaguacuauucaauuauaccacauucaauacgauccauccaaucagauaggaaagcaugggcugccuuuuauguauauaaacuucaaccucugacauuccucuuagauuuuucagucgauggauauauacgccgcgcaauagauugcgguuuuaaugaccuaagucaacuccacuguucuuacgaaucauuugaugucgaaucuggaguguacucaguaagcucauucgaagcaaaaccuucagguaguguaguagaacaagccgaaggaguggaaugugacuucucaccucuucuaucaggaacacccccucaaguguauaacuucaaacgauuaguuuucaccaauuguaauuacaacuuuaccaaacuauuaucauuauuuucugucaaugacuucacaugcagccaaaucaguccagcagcuauagcaucaaacugcuacuccucucucauacuugacuauuucucuuauccauuauccaugaaauccgaccucagcgucuccucagcagggcccauuucacaauuuaacuauaaacaaucauucagcaauccaacaugucuaauacuugcuacaguaccucauaaucuaaccacuauaacaaaaccccuaaaauacuccuauauaaauaaauguucacgucuucuaucagacgaccguaccgaagugccgcaauuagugaacgcuaaucaauauucaccaugugucucaauaguuccuucuacuguaugggaagauggagauuauuaccguaaacaacucaguccauuagaagguggcggaugguuaguugccagcggaucaacaguagcuaugaccgaacaacuacagaugggcuucggcauaacaguacaauacgguacagauacuaauucgguauguccuaaauuagaguucgcaaaugauacuaaaaucgcuucucaacuugggaauugcguagaauacucacuauauggagucucuggaagagguguauuucaaaacuguaccgcuguugggguacgacaacaaagauuuguauacgacgcguaucaaaaucucguugguuauuauagugacgacgguaacuauuacugucugagagcgugcguuagcguaccaguaagcguaauauaugauaaagaaacuaagacacaugcuacucuuuuugguucgguagcaugcgaacacauuucauccacuaugucacaauauucucguuccacacgauccauguuaaaaagacgagauuccacauacggcccauuacaaacuccaguuggaugcguacucgggcuaguaaauucuucacuuuuugucgaagacuguaaauuaccauuaggacaaucuuuaugugcauugcccgauaccccaucuacucuaacucccagaucugucagaucuguuccaggagaaaugcgucuugcaucaaucgcauuuaaucacccuauacaaguagaucaauuaaauuccagcuacuuuaaacuauccauacccacaaauuuuucuuuugguguuacacaagaauauauucaaacaacaauucagaaggucacugucgauuguaaacaauaugucuguaauggauuccagaaaugugagcaacuacuaagagaauacggucaguucugcucgaaaaucaaccaagcccuucauggugccaaccucagacaggaugauucagugcgaaaccucuucgccagcgugaaauccucucagucuucaccaaucauucccggauucggaggagacuuuaaccuuacuuuacuggaaccaguuaguaucaguaccggaucacguagcgcccgaucagccaucgaagaucucuuauuugauaaaguuacaauagcugauccuggauacaugcaaggcuaugaugauugcaugcaacaaggaccggcaucagcacgggauuuaauaugugcccaguaugucgcuggauauaaaguauuaccucccuuaauggacguuaauauggaggcugcauauaccagcucauuauuaggaucuauagcuggagucgguuggacugcagguuuaucauccuucgcagcaauacccuucgcacaaagcaucuuuuaucgacuuaaugguguagguaucacacaacaaguacuuucagaaaaucaaaaauugauugcaaauaaguucaaucaggcacucggagcaaugcagacugguuuuacgaccacaaacgaagcauuucguaagguucaagacgcuguaaauaacaacgcacaagcacuaaguaaacuagcuagugaacuaagcaauaccuuuggcgcaauuucggcauccauaggagacauaauucaaagacuugauguccuugaacaagacgcacaaaucgaccguuugauuaacggacgacuuacaacacuaaaugccuuugucgcacaacaauuaguacguucagaaucagccgcauuaucagcccaacuugccaaagacaaaguaaaugaaugcgucaaagcacaaucaaaacgcaguggcuucugcggucaagguacccacauuguuuccuucguaguaaaugcaccaaauggacuuuacuucaugcauguuggauacuaucccucaaaccauauagaagucguuuccgcuuauggucuaugugaugcugccaacccaacaaacugcauugcaccagucaacggcuauuuuauaaaaacuaauaauacucguauuguugaugaauggagcuacacugguucuucauucuacgcaccagaacccauaacgagcuuaaauacaaaauacgucgcaccucaagugacauaucagaauauauccacaaacuuaccaccaccucuucuaggaaauucuacugguaucgauuuccaagacgaauuggaugaguucuucaaaaacgugucaacuagcauuccaaauuuuggaucucuaacacaaauuaauacaacuuuauuagaccugacuuacgaaaugcuaucauuacaacaaguaguuaaagcucuaaacgaaucauauauugaccuuaaagaacuaggaaauuauacauacuauaacaaauggccuugguacauaugguuagguuucauugcuggcuuaguagcauuagcuuuauguguuuucuuuauccuaugcuguaccggauguggaacaaacuguaugggaaaacuaaaauguaauagaugcugugaccgauaugaagaauaugaccuagaaccucacaagguucauguacauuga

SEQ ID NO: 1135 - RNA, 4062 nt, Artificial Sequence
  derived and/or modified CDS sequence (opt6) from MERS-CoV__ANC28656__S
augauacauucaguauuucuacucauguuucuacuaaccccuaccgagaguuacguggauguaggaccugauucaguuaaauccgccuguauugaaguagacauucaacaaacuuucuucgacaaaacauggccaagacccauagauguaucuaaggcagacgguauaaucuacccucaaggaagaacauauucuaacauaacaauaacauaucaaggacucuucccguaucagggagaucauggcgauauguacguuuacucagcaggacacgccaccgguacaaccccucagaaauuauucguagcaaauuauucacaagauguaaaacaauuugcaaauggauuuguagucagaaucggagcugcagcaaacucaacaggaacaguaauaauaaguccaucaacaucugcaacgauaagaaaaaucuauccugccuuuauguuaggcuccucuguugguaacuuuuccgauggaaaaaugggacgauucuuuaaccacacucuaguucucuuaccugacggaugcggcacucuccuaagagcauuuuacuguauacuagaaccacgauccgggaaucacugcccagcggguaauucguacaccagcuucgcuacauaccacaccccagcaacagauugcucagacggaaauuacaaucgaaacgccucacuuaauucuuuuaaagaguacuucaaccuacgaaauuguacuuucauguacacauauaauauuacagaagaugaaauacuagaaugguuuggcauaacacaaacugcacaaggcguccauuuauuuuccucacguuauguugaccucuauggagguaauauguuucaauuugcaaccuuacccguauacgacacgauaaaauauuacucaauaauuccccauaguauaagaucaauacaguccgaucggaaagccugggcugcauuuuacgucuauaaacuacaaccccuaaccuuuuuacuggauuuuuccgucgauggauacauaagacgagcaaucgacugcgguuuuaaugauuuaagccaauuacauuguaguuaugagucauuugacguugagucaggcguauauaguguuucgagcuuugaggcuaaaccgucuggaucugucgucgaacaagccgaaggagucgagugugacuucucuccauuauuaucagguacacccccacaaguguauaauuucaaaagauuaguuuuuacaaacuguaauuacaaccuuaccaagcuacucucacuauuuucuguaaacgauuuuacaugcagucaaauuucuccggcagccauagcaucaaauugcuauucaucauuaauacucgacuacuucucauauccucuuucuaugaaaucggauuuauccguuagcucugcagggccaauaagccaauucaauuacaaacaaucauucucaaaccccacauguuuaauacuugcaacuguuccacauaaccuaaccaccauaacgaaaccauuaaaauacucuuauauaaauaaaugcucccgacuucugucagauggcagaacagaaguaccacaacuuguaaaugccaaccaauauucaccaugcguaucaauaguaccaucaacaguuugggaagacggagacuacuauagaaaacaacuaucaccccuagaagggggcgguugguuagucgcauccgggucaacuguagccaugacagaacaauuacaaauggguuucggaauaacaguucaauacggcacagauacuaauucgguuuguccuaaauuagaauuugcuaaugacacaaaaauagcaagucaacucgggaacugcguugaauauucuuuauacggcguaucgggaagaggaguauuucagaacuguaccgcaguuggaguacgccaacaacguuucguuuacgaugcauaucaaaacuuaguugguuacuauucugaugacgguaauuauuacugccuacgcgcauguguuucagucccagucucugucauauacgauaaagaaacuaagacacacgcuacccuauucggaucaguagcaugugaacacauaagcucuacaaugagccaauacucccgauccacucgauccaugcuaaaacgaagagauucuaccuauggaccccuucagacaccuguaggauguguuuuaggccuagucaauagcagccuuuucguagaagauuguaaauuaccacuaggacaaucgcuaugcgcucuaccggauacucccucaacccuaacuccccgauccgucagaucaguuccaggagaaaugagacuagcaucaauugccuuuaaucauccaauucaaguugaucagcucaauuccucauauuucaaacuuagcauuccaacaaauuuuaguuuuggaguuacucaagaauacauacaaaccacgauacaaaaagugaccguagauuguaaacaauauguuugcaacggcuuccagaaaugugaacaacuauuaagagaauauggccaauucugcagcaaaauuaaucaagcauuacacggugcuaauuuacggcaagaugacucagucagaaaucuuuucgccaguguaaaaucgagccaaucuuccccuauaaucccaggauuuggaggagauuuuaaucucacccucuuagaaccaguaucuaucuccacuggaucacgaucugcaagaagugccauagaagacuuacuauucgauaaagugacgauagcugauccagguuauaugcaaggauaugacgacugcaugcaacaaggcccugccucugcaagagaccuaauaugcgcacaauauguagcaggcuauaaaguacuuccaccacuaauggacguuaauauggaagcagcuuacacuucuucuuuauuaggcucuauugccgguguagguuggaccgcaggucuaucgaguuuugcugcgauaccauuugcucagucaauuuucuaccgcuuaaauggagucggaauaacucaacaaguauuaucagaaaaccaaaaacuaaucgccaauaaauuuaaucaagcucucggugcaaugcaaacgggcuuuacuaccaccaaugaagccuuuagaaagguucaagaugcugugaacaacaacgcacaagcacugucaaaacuugccucugaacuuagcaacacauuuggagcaaucucugccucuauaggugacauaauacaaagauuagauguucuugaacaagaugcucaaauugauagauuaauaaauggcagacuaaccaccuugaacgcauucguggcccaacaacuuguacgcagcgaaagugcugcacuaucagcucaacuggcaaaagacaaaguaaaugaauguguaaaagcucaauccaaacguaguggauucuguggacaaggaacacauauaguaaguuuuguaguuaaugcuccaaacggccucuauuucaugcauguagguuacuauccaucuaaucacauagaagucguuucagcauaugguuuaugugaugcugccaauccuacgaauugcauugccccagucaauggauacuuuauaaaaacuaacaacacucgcauaguagacgaauggucauauacaggcagcuccuucuacgcacccgaaccaauaacaucacucaauacgaaauacgucgcuccccaagucacauaccaaaacauuucaacuaaccuaccuccuccauuacucgguaacucuaccggcauugauuuucaagacgaauuagacgaauuuuucaaaaacgucucaaccucaauaccuaauuuuggaaguuuaacacaaauuaauacaacacuccuagaccuaaccuacgaaaugcuuucacuccaacaaguuguuaaagcucuuaaugaaucguauauugauuuaaaagaacuaggcaauuauaccuacuauaauaaguggccaugguacaucuggcuagguuuuauagcagggcuaguagcacuugcauuauguguauucuuuaucuuauguugcacaggauguggaacuaacuguaugggaaagcuaaaaugcaacagguguugcgaucguuacgaagaguacgaccuagaaccucauaaaguucauguucauuaa

SEQ ID NO: 1136 - RNA, 4062 nt, Artificial Sequence
  derived and/or modified CDS sequence (opt6) from MERS-CoV__ANC28678__S
augauccacucaguauuucucuuaauguuccuucuaacaccaaccgaaucuuauguggacgucggucccgacuccgucaaauccgcaugcauagaaguagauauacaacaaacauucuucgacaaaacauggccaagaccuauagaugucucaaaggcagauggaauaauuuauccgcaaggccguacauauucuaauauaaccauuacuuaccaaggauuauuucccuaccagggugaccauggcgacauguacguauacagcgccggacacgcuacaggaaccacaccacaaaaacuauuuguugccaauuacagucaggacguaaaacaauucgcgaacggauuuguuguacgaauaggagccgcagcuaacaguacaggaacagugauaaucucaccaucaacaucagcaacaauuagaaaaaucuacccagcauucauguuaggcucaucaguaggaaauuucucugacgguaaaaugggucguuucuuuaaucacacauuaguucuuuuaccagauggauguggaacacuauugagagcauuuuauuguauauuagaaccaagauccggcaaucacugcccagcuggcaauucguacacuucuuucgccacguaccacacaccagcuacugauuguucugauggcaauuauaauaggaaugcaucauuaaacucauucaaagaauacuuuaaccuuagaaauugcacauuuauguacacuuacaacaucacagaagaugaaauacucgaaugguuuggaauaacacaaacagcacaaggaguacauuuauucucuagcagauauguagaucuuuacggcggaaacauguuucaauuugcuacacuacccguauaugauacuauaaaauauuacucaauuauaccacacucaauuuguucaauacaaucagacagaaaagccugggcagcguucuauguauauaaacuacaaccccucaccuuccuucuugacuuuagcgucgacggguacauucguagagcaauugauugcggauucaacgaccuaagccaacuacacuguucauacgaauccuucgauguagaaagcggaguauacucgguuucuucauuugaagcuaaaccuucugguuccgugguagaacaagcagaaggaguugaaugcgauuucucaccauuacuaucaggcacaccuccacaaguauauaacuucaaaagacuuguuuuuacuaacugcaacuauaauuuaaccaaauuauuaucacuuuuuagcgucaacgauuuuacauguucucaaauaucuccugcagccaucgcaucuaauugcuacaguaguuuaauucuagacuacuuuagcuauccucucaguaugaaaagugacuugaguguuuccagugccggucccauuucucaauuuaauuacaaacagagcuuuucaaauccuacuugucucauacuugcaacuguaccucacaauuuaacaacuaucaccaaaccucuaaaauacucuuauauuaauaaauguucccgauuacuaagugacggaagaaccgaaguaccccagcuagugaaugcaaaucaauauucacccugcguuuccaucguuccaucaacagucugggaagacggagacuacuaccgcaaacaacuaucucccuuagaagguggaggauggcuaguagcuuccggaucuacaguggccaugaccgaacaacuucaaauggguuucgguauaacagugcaauauggaacugacacaaacucgguauguccuaaauuggaauuugcgaaugacacaaaaauagcaucacaauuaggcaauugcguagaauauucuuuauacggaguaucaggcaggggcguuuuucaaaauugcacagcuguaggaguaagacaacagagauucgucuaugaugcuuaucaaaauuuaguagguuauuauucggacgauggaaauuauuauugccuacgagcuugcguaucugucccagucuccguaauuuaugauaaagaaacaaaaacucacgcuacccuauuuggaucuguugccugugaacauauaucaucaacaaugagucaguauucacgaucaacacguucaauguuaaaacgccgugacucgacauacgguccacuucaaacacccguaggauguguacuuggacuuguaaacucaucacuauucguagaagauugcaaacuuccucuuggacaaucgcuuugcgcacuuccagacaccccaucaacccucacaccaagaucaguacgcucagucccaggagaaaugagacuugcaucaauugcauuuaaucacccaauucagguagaccaacucaacuccucauauuucaaauuauccauuccaacaaauuuuucuuuugguguaacacaagaauauauucaaacuacgauacaaaaaguaacgguagacugcaaacaauacgucuguaauggauuccaaaaaugcgaacaacuacuaagagaauauggacaauucugcuccaaaauaaaucaagcucuacauggugcuaaccuacgucaagacgacucugucagaaaucuauucgcaucaguuaaaucaucacaaucaucuccuaucauaccaggauucggaggagauuucaaccuaacacuauuagaaccaguauccauaucuacgggaucuagauccgcacgauccgcgauagaagaucuccucuuugauaaaguaacaaucgcagauccaggcuacaugcaaggauacgacgacuguaugcaacagggaccagcaucagccagagauuuaauaugugcacaauauguagcuggauauaaaguucuaccuccccucauggaugucaacauggaagcugcguauacaucuucucuacucggauccauagcggguguaggauggacagcgggccuaaguuccuucgccgcaauucccuuugcacaaagcauauuuuauagacuuaaugguguuggcauuacacaacaaguccucagugaaaaucaaaaacuaauugcuaauaaauucaaccaagcgcucggugcaaugcagacuggcuuuacuacuacaaaugaggcuuuuagaaaaguacaagacgcuguuaacaacaaugcacaagcucuuucgaaacuagcaucagaacucucaaauacguucggagccauauccgcuucuauaggagacauaauacaacgucucgauguucuugaacaagaugcacaaauagaucguuuaauuaacggacguuuaaccacucucaacgcauucguagcacaacaauuagugagaagcgaaucagccgcacuuucagcacaauuagcuaaagacaaaguaaaugaaugcguaaaagcacaaucaaaacgcaguggauuuuguggccaaggcacucauauagucuccuuuguaguuaaugcacccaaugguuuauauuucaugcaugucggauauuaccccucuaaccauauagaaguggucucugcauauggucuuugcgacgcugcuaacccaacuaacugcaucgccccaguuaacggauacuucauuaaaaccaacaauacaagaauaguugaugaauggucguauacaggaucaucuuuuuacgcccccgaaccuauuacgucauuaaacacaaaauauguagcuccacaaguuacauaucaaaauauaucuacuaacuuacccccacccuuacucgguaauucaacaggcaucgauuuccaagaugaacuagacgaguucuuuaaaaauguuucuacuuccauaccaaauuuuggaucacuaacucagauaaauacaacucucuuagauuuaacuuaugaaaugcuauccuuacaacaagucgucaaagcccuuaacgaauccuauauagacuuaaaagaacucgguaauuacaccuauuauaauaaauggccaugguacauaugguuaggauuuauagcuggccuaguagccuuagccuuauguguauuuuucauacuaugcugcacuggaugcggaacaaauugcauggguaaacuuaagugcaaucgcuguugugaucgauaugaagaauacgauuuggaaccacacaaaguacacguacacuaa

SEQ ID NO: 1137 - RNA, 4059 nt, Artificial Sequence
  derived and/or modified CDS sequence (opt6) from MERS-CoV__AHL18090__S
augauacauucaguauuucuauuaauguuuuuauuaacuccuaccgaaucauacgucgacguaggacuugauucagcuaaaagcgcuuguauagaagucgauauucagcaaaccuucuucgauaaaacuuggccacguccaaucgaugucucuaaagcugacggaauaauuuauccucaaggaagaacuuacagcaacauuacaauaacuuaccaaggucucuuuccauaucaaggcgaucacggagauauguauguauauucagccggucacgcaacaggaacaaccccacaaaaauuauucguugcaaauuacucacaagauguuaagcaauucgcuaacggcuuuguuguaagaauaggagccgcugcuaauaguacuggcaccguuauuauauccccuaguaccucagcuacuauuagaaaaauauacccagcauucauguuagguaguuccguaggcaauuuuuccgacggcaaaaugggaagauucuuuaaccauacacuuguacuacuaccagauggcugcggaacuuuauuacgagcuuuuuauugcauacuagaaccacguagcggcaauuacugccccgcaggaaacucauacaccaguuucgccacuuaucauacuccugcaacugauuguucugacggaaacuacaaucguaaugcaucacucaauucauuuaaagaauauuucaaucuacguaauugcacuuuuauguauacauacaacaucacagaagacgaaauauuagaaugguucggaauaacucaaacugcccaaggaguucaucucuuuucuucacgcuauguagauuuauacggcgguaauauguuucaauucgcuacacucccaguuuaugacacaauuaaauauuauaguauaauaccacauaguauacguuccauacaaucugaucguaaggcuugggcagccuuuuauguauauaaacuacaaccccuaacuuuccucuuagacuuuucuguagacgguuacauccguagagcuauagauugcggauucaaugaucuaucucaauuacacugcucauaugagucauucgauguugaaucaggaguuuauucuguuuccucuuucgaagcuaaaccuucuggauccgucguagaacaagcagaaggcguagaaugugacuuuucccccuuacucucagggacaccaccacaaguuuauaauuucaaacgccuaguuuuuacuaauuguaauuacaauuuaacgaaauugcuaagccucuucucaguaaaugacuucacauguucccaaauuaguccagcugcaauauccuccaauugcuauucaucacuaauuuuagauuauuucuccuauccccuuucaaugaaaucagaucuaucuguauccucugcugguccuauaagucaauucaacuauaaacaauccuuuuccaacccgacaugucuuauucuugcuacaguaccacauaacuugaccacuaucaccaagccgcucaaauacucuuacaucaauaaaugcaguagacugcuaucugaugauagaacagaaguaccacagcuaguuaacgcuaaccaauauucaccauguguuucgauuguaccaucaacugucugggaagacggugacuacuaucguaaacaacucuccccacucgaagggggugguuggcugguggcuucaggguccaccgucgcaaugacagagcaacuacaaaugggcuuuggaaucacaguccaauacggaacggauacuaauucaguuuguccaaaacucgaauuugccaaugauacaaaaauugcuucccaauuaggaaacuguguugaauauucauuauauggcguaucuggaagagguguauuccaaaauugcacagcuguaggugucagacaacaaagauuuguguaugaugccuaucaaaaccucguaggauauuauagcgaugacgguaauuauuauugucuacgagcuugcgugucuguuccaguaucagucauauaugacaagaaaacuaaaacccaugcuacacuauuugguucuguugccugcgaacauauuucguccaccaugucccaauacucacgaucaacacguucaacucuaaaaagaagggacuccacauauggcccucuucaaacacccguaggcugcguucuuggacuugucaauucaucccuauuuguugaagauuguaaacuaccacuaggccaaucacuaugcgcucuaccagacacgcccucuaccuuaacgccucguuccguuagaucuguuccaggucaaaugcgacuagcaaguauugcauucaaucacccaauucaagucgaucaacuaaauagcucauauuucaaacuaaguaucccaaccaacuuuagcuucgguguaacccaagaguauauccaaaccacaauucaaaaaguaacagucgacuguaaacaauacgucugcaacgguuuucaaaaaugugaacaacuacuucgugaguacggacaauuuuguucaaaaaucaaucaagcccuucauggagcaaauuugcgucaagaugauagugugcgaaaccuguuugcuagugucaaauccucacaauccucuccaauuauaccugguuuuggaggugacuuuaaucuaacucuucuagaaccaguaucgauuucaacagguucaagaucuucucguauagccauagaagauuuacuuuuugauaaaguuaccauagccgauccaggcuacaugcaagguuacgacgauuguaugcaacaaggaccaucaucggcgagagauuuaauuugugcccaauaugucgccggauauaaaguauuacccccuuuaauggauguaaauauggaagcggccuauaccuccagucuacuuggaucaaucgcaggagucgguuggacagcagguuugucauccuuugcagccauaccauuugcacaaucaauauuuuacagacucaacgguguaggaauuacacaacaaguauuaagcgaaaaucaaaaacuuauagccaacaaauucaaccaagcacuaggagcaaugcaaacugguuucacgacaacuaacgaggcuuuucaaaaaguacaagacgcugucaacaacaacgcacaagcucuuucaaaacuugcaucagaacuaucaaacacuuucggagccauaucugcaucaauaggagacauaauacagagauuagacguauuagaacaagaugcacaaauagaucgccuaauuaauggacgacuaacaacauuaaaugcuuucguugcacaacaauuaguaagaucugaauccgcugccuuaagcgcacaacucgcaaaagacaaagucaacgaaugcguaaaagcacaaucgaaacgaaguggauuuugcggacaaggaacucauauaguuaguuucguaguaaacgcaccuaacggucucuauuucaugcacguagguuauuauccuucuaaucacaucgaaguaguuucugcauauggacuaugcgacagugcaaaucccacaaacuguauugcuccaguaaacggauauuucaucaaaacaaauaauacaagaauaguagaugaaugguccuacaccggcagcucauuuuaugcuccagaacccauaacaagucucaacacaaaauauguugcuccacaagucacauaucaaaauauuaguacaaaucucccaccaccacuucuuggaaauucaacaggaaucgacuuucaagaugaacucgacgaguucuucaaaaacguauccacuucaauuccuaauuucggaucccugacacaaauuaauacgacacuauuagaucuuaccuaugaaaugcuaucacuacaacaaguaguaaaagcccucaacgaaucauacauugauuugaaggaacuggguaacuauacauacuauaaauggcccugguacauaugguuaggauuuaucgcaggauuagucgcauuagcccuguguguuuucuuuauauuauguuguacuggcugugguacaaauuguaugggaaaacuuaaacguaacagauguugugacagguacgaagaauacgauuuagaaccucauaaaguacauguccauuag

SEQ ID NO: 1138 - RNA, 4062 nt, Artificial Sequence
  derived and/or modified CDS sequence (opt6) from MERS-CoV__AHX00731__S
augauccauucaguauuucuucuaauguuucuauuaacgccaaccgaaagcuaugucgauguuggacccgauagcguaaaauccgcuuguauagaagucgauauacaacaaaccuucuuugacaaaacauggccaaggccaauagacguaucaaaggcugacgguauaauauauccccagggaagaacauauucaaauaucacaauaacauaccagggccuguuccccuaucaaggugaucacggggacauguauguuuauucagcuggacaugcaacaggcacuacaccccaaaaauuauuuguggcaaauuauucacaagaugugaagcaauuugcaaauggauucguuguuaggauaggagcagccgcuaacucaacaggcaccgucauaauaagccccagcaccucugcuacaauaagaaaaauauacccagccuuuaugcuugguuccucgguagguaacuucucugacggcaaaaugggucgcuuuuucaaccauaccuuaguucuacuuccugauggauguggaacacuauuaagagcauucuacugcauacucgagccaaggucugggaaucauugccccgcuggaaauuccuacacaucauuugccacauaucacaccccagcaaccgacugcagcgauggaaauuacaaccgaaaugcuucccuaaauaguuuuaaagaauauuuuaaucuacggaauugcacauucauguacacuuacaacauuacggaagaugaaauacuagaaugguuuggaauuacacaaacugcucaaggcguccaucuauuuucaucuagauacgucgauuuauauggaggaaacauguuucaauuugcuacucuaccuguauacgauacaaucaaauacuacucgauuauaccacauucaauaagguccauacaauccgaccgaaaagcaugggcagcuuuuuacgucuauaaacuacagccacuaacuuuucugcuugauuuuuccguagauggauacauuagacgagcaaucgauuguggauuuaacgauuuaucucagcuucacuguucuuacgaauccuuugacguggaaucaggugucuacucagucucaaguuuugaagcaaaaccuucaggauccguugucgaacaagcagaaggggucgaaugcgauuucucaccucuacucagcgguacuccuccacaaguauacaauuucaaaagauuagucuuuacaaauuguaacuauaaccuuacaaaacuacucagucucuuuuccgucaaugauuuuaccugcucacaaauauccccagcugccaucgcaucaaacugcuacucuucccuaauauuagauuacuucucuuauccacuuucaaugaaaucagauuuaggcguuucuucagcuggaccuaucucgcaauucaauuacaaacaaucauuuucuaauccaaccuguuuaauauuagcaacaguuccacauaacuuaacaacaauaacaaaacccuuaaaauacaguuacaucaacaaaugcucaagacuccuaucugaugauagaacagaaguuccucaauuaguuaacgccaaucaauacaguccgugcguaucaauaguaccaucaacaguuugggaggauggugacuacuauagaaaacaacuuagcccucucgaagguggcggauggcucguagccucuggaucaacaguagcaaugacggaacaacuccaaauggguuucggaauuacaguacaguauggaacugacacaaacucaguauguccuaaguuagaauuugccaacgacacaaaaaucgcaucacaauugggaaauuguguagaauauucauuauacgguguaucugguagaggagucuuccaaaauuguacagcaguuggaguaaggcaacaaagauuuguuuaugaugcauaccaaaaccuaguagguuauuacucugacgauggcaauuauuacugucuaagagcuuguguauccguaccaguaucaguaauauacgauaaagaaacuaaaacucaugcaacccucuuuggaucaguagcaugcgaacauaucucaucuacaaugucacaauauucaagaucaacaaggucaauguuaaaacgaagagauaguacuuacgguccccuucaaacaccagugggauguguccuaggucuuguaaauucaucacuuuucguggaagacugcaaacuuccacucggccaaucucuaugugcacuuccagacacccccaguacccucacaccuagaucaguacgcucaguuccuggagaaaugagacuugcaucaauagcauucaaccacccuauucaaguugaucaauucaauagcucauacuucaaauugucgauuccuacuaacuucucauucggcgucacucaagaauauauacaaacaacuauacaaaaaguaacuguugacugcaaacaguacauaugcaauggcuuccaaaaaugugaacaauuacuucgugaauacggucaauuuugcuccaaaaucaaucaagcauugcauggugcuaaucuaagacaagacgauucugucagaaauuuauucgcaucuguaaaaaguagccaaucaucaccuauaauaccagguuucgggggugauuucaaucucaccuugcuagaaccaguauccauuuccacagguucacgcucagcuagaucagccauugaagacuuacuauucgacaaagucaccaucgcagaucccgguuauaugcaaggauacgacgauuguaugcaacaaggaccagcuucagcacgagauuuaauuugcgcucaguauguugcagguuauaaagugcuaccaccccuaauggacguaaauauggaagccgcuuacacgaguucacuuuuagguagcauugcuggaguaggauggacagcuggucuuucuucauuugccgccauacccuuugcucaaucuauauucuacagacucaacggaguagguauaacacaacaaguucuaucagaaaaccaaaaacuaauagcuaacaaguucaaucaagcacucggagcaaugcaaacuggauuuacgacgaccaaugaagccuucagaaaaguucaagaugcugugaacaauaaugcacaagcucuauccaaacuagcuucagaauugucuaacacauucggagccauuuccgcgucuauuggcgauauuauucaaagacuugauguuuuggaacaagaugcacaaauugauagauuaaucaauggccgacuaacaacuuuaaacgccuuuguagcccaacaauuagucagauccgaauccgcagcgcucucagcacaacuugcaaaagacaaaguuaaugaauguguaaaagcacaaucgaaacguuccggcuuuugcggucaaggcacucauauaguuucauuuguuguuaaugccccaaacggccuguacuucaugcauguugguuauuauccuaguaaccauauagaagucgucuccgcuuauggucuuugcgacgcugcuaacccaacaaacugcauagcaccaguaaacggauacuucaucaaaacaaauaauacaagaauaguugaugaaugguccuauaccggaaguucuuuuuauuccccagaacccauaacuagcuuaaacacaaaauauguugccccucaagucacuuaucaaaauaucucaacaaaucuaccaccaccauuauuaggcaauucaacuggaauagauuuccaagacgaacuugaugaguucuucaaaaacguaucuacuuccauaccuaacuucgguucuuuaacacagauuaauacaacucuccuagauuuaacuuaugaaaugcuaucgcuacaacaagugguaaaagcucuaaaugaauccuauauagauuuaaaagaguugggaaauuacacguauuauaauaaauggccuugguauaucuggcucgguuuuauugccggauuagucgcacucgcauuauguguauuuuucauccucuguugcacaggaugugggacuaacuguaugggcaaauuaaaaugcaacagauguugcgaccgcuacgaggaauaugacuuagaaccucacaaaguucauguacacuaa

SEQ ID NO: 1139 - RNA, 4062 nt, Artificial Sequence
  derived and/or modified CDS sequence (opt6) from MERS-CoV__AHX71946__S
augauucauucaguauuucuacuaauguuccucuuaaccccaaccgaaucauauguagauguaggaccggauucugucaagucggcaugcauagaagucgauauccaacaaacuuucuucgacaaaaccuggccccgacccauugacgucucuaaagcugacggaauaauauacccccaaggucguacuuacuccaauaucacaaucacuuaucaaggacuuuucccuuaucaaggagaccauggagauauguauguauacucagcaggucacgcuacuggaacaacaccacaaaaacucuucguugcaaacuacucacaagauguaaaacaauuugcuaauggauucgucguuagaauuggugccgccgcaaacucuacggggacaguuauaauuaguccaucuacaucagcuacgauacgcaaaauauaccccgcuuucaugcuaggauccucagucggaaauuuuucugacggaaaaaugggucgauucuuuaaccacaccuuaguacuauuaccggacgguuguggcacauugcuacgggcguuuuacugcauauuagaaccccgaucgggaaaccauugcccagcaggaaauucucauacgaguuuugccaccuaucauaccccagcgaccgacugcuccgauggcaauuacaacaggaaugccucacuaaauagcuuuaaagaauauuuuaaccuucgcaacuguacauucauguacaccuacaacauaacagaagaugagauccuugaaugguuuggcaucacucaaacagcucaagguguucaucucuucucuucucgcuauguugauuuauauggcggaaauauguuccaauuugcaacuuuaccaguauaugauacuauaaaauauuacucaauuauaccccauagcauuagaagcauacaaucggacagaaaggcuugggcagcauuuuaugucuauaaacuacaaccguugacuuuucuacuugauuucucaguagauggauauauaaggcgagcuauagauuguggguuuaaugacuuaucacaacuucauuguuccuacgaaaguuucgaugucgaaucugguguuuauucuguaucuucauucgaagcaaaaccgucaggaucagucgucgaacaagcagaaggaguugaaugugacuuuucaccccuacuaucaggaacaccuccccaaguauacaauuuuaaaagauuaguauuuacuaacuguaauuacaaccuuacgaaguuguuaucucuauuuagugucaacgauuucacaugcucucaaauaagcccagcagcgaucgcuucgaauuguuauucuucacuaauccucgauuauuuuucauacccauuaucaaugaaaucagauuuauccguaucuagugccggaccaauaucacaauuuaauuacaaacagagcuuuucuaaccccacuugccuuauacuagcgacuguaccccauaaucuuacaacuauaacaaagccucucaaauacucauauauaaauaagugcucaagacuacuuucugaugaccgaaccgaaguuccccaauugguaaacgcaaaccaauacuccccuuguguguccaucguuccaucaacagucugggaagacggggauuacuacagaaaacaauuaucgccauuagaaggaggcggaugguugguggcaucaggaucuacaguagcuaugacggaacaauuacaaaugggcuuuggaaucaccguacaauacggaacugacacaaauuccguuugccccaaacucgaauuugcuaaugauacuaaaauagccucacaacucgguaacuguguagaauauucauuauacggcguuucuggcagaggaguauuucaaaacuguacagcuguuggaguaagacaacaaagauuuguauaugacgcuuaucaaaaucucguaggcuacuauucagaugacgguaacuacuauugcuugagagcauguguuaguguccccguaucuguuauauaugauaaagaaaccaaaacccacgcaacuuuauuugguaguguagcaugugagcauauuucaaguacaaugagccaauacagccgaucaacacgcucaaugcuaaaaagaagagacagcaccuauggucccuuacaaacaccggugggcugcgugcuaggucuagucaacuccucccucuucguagaagacugcaaauuacccuuaggucaaucacuuugugcuuuaccagauacaccuaguacacuaacuccacgaucuguucgcucaguacccggagaaaugcgacuugcaucaauagccuucaaucauccuauacaaguagaccaauuaaauuccucauacuuuaaacuuucuauaccaacaaauuuuucuuuuggcguaacccaagaauacauacaaacaacaauacaaaaggucacaguagauugcaagcaauauguauguaauggauuucagaaaugcgagcaacuacuaagagaauauggacaauucuguaguaaaauaaaccaagccuuacauggcgcaaaccuaagacaagacgauagcguaagaaaccuauuugcuucaguuaaaucaucucaaucuagcccaauaaucccagguuucggcggagauuucaaucucaccuuacucgaacccgucucaauaucuacaggcucacgauccgccagaucagccauagaagaccuacuauuugauaaaguaaccauugcagacccuggauauaugcaaggcuaugaugauuguaugcaacaaggcccagcuagcgcuagagacuuaauaugugcccaauacgucgccgguuauaaaguacuuccaccuuuaauggacgugaacauggaagcugcauacacaucaucgcuccuaggguccauagcaggcguagguuggaccgcaggucuaucauccuuugcagcaauaccauuugcucaaucaauauucuacagauuaaaugguguaggaaucacacaacaaguacuaucagaaaaucaaaaauuaauugcuaauaaguuuaaucaagcccuaggagccaugcaaacuggauuuacaacaacaaacgaagcauuucguaaaguucaagaugcgguaaauaacaaugcacaagcacuaagcaaacuagcaucagaacuaucaaacaccuuuggagccauaucagcaucuauuggcgacauaauacaacgucuagauguacuagaacaagaugcacaaauagauagauuaauaaacgguagacucacaacccuaaaugcauucguagcacagcaauuaguacgaucagaaucugccgcacugagcgcacaacuagcaaaggauaaaguaaaugagugugugaaagcacaaucuaaacgaucugguuuuuguggacaaggaacacauauagucucuuuuguuguaaacgcaccaaauggucuauacuuuaugcauguugguuauuauccaucaaaccacauugaggucguaucugccuauggauuaugugaugcagcaaacccuacuaauugcauagcgccagucaauggauauuucauuaaaacaaacaacacacguauugucgacgaauggucauacacuggcucaucauucuacgccccagagccuauaacaagccucaauacaaaauacguagcaccacaaguaacuuaccagaauauaucaacuaauuuaccuccaccacuacuuggaaauucaacagguauagacuuucaagaugaacuugaugaauuuuucaaaaacguuucaacuagcauccccaacuuugguuccuuaacacaaaucaacacaacacucuuagaucuaacuuaugaaaugcuuucucuucaacaaguagugaaagcacugaacgaaaguuacauagaucuuaaagaacugggaaauuauacauauuacaauaaauggccuugguauaucugguuagguuuuauagcaggccuuguagcacuagcuuuauguguauucuuuauauugugcuguacuggauguggaacaaauuguaugggcaaauuaaaauguaaucgaugcugugaccgauaugaagaauacgaucuugagccacauaaagugcacguacauuaa

SEQ ID NO: 1140 - RNA, 4062 nt, Artificial Sequence
  derived and/or modified CDS sequence (opt6) from MERS-CoV__AHY22545__S
augauccacagcgucuuccuacuuauguucuuacuaacaccuacagaaucuuacguagacguuggucccgacuccguuaaaucagcuuguauagaaguagacauacaacaaacguucuuugacaaaacuuggccacguccuauagacguuaguaaagccgauggcauaaucuauccccaaggaagaaccuauagcaacauaacuauaacauaucaaggucuauuucccuaccaaggugaccacggcgacauguacguauauucugcaggucaugcuacaggaacaacuccucagaaauuauucguagcaaauuacucucaggauguaaagcaauuugcaaacggauucguaguaagaaucggagcagccgcaaacuccacuggaacaguaauaauuucaccuuccacaagugcaacuauaagaaaaauauauccagcuuucaugcucggaucuucgguaggaaauuuuuccgauggcaaaauggguagauuuuucaaccacacacuuguacuauuacccgacggcuguggaacccuacuaagagccuucuauuguauacuugaaccuagauccgguaaucacuguccagcaggaaauucauacacuuccuuugccacuuaccauaccccagcuacugacuguuccgacgguaauuauaauagaaaugcaucacuaaauaguuucaaagaauauuuuaauuuaagaaacugcacauucauguauacguauaacauaaccgaagacgaaauauuagaaugguuugguauaacucaaacugcacaggguguucaucuuuuuaguucaagauacguagaucuauauggaggaaacauguuccaauucgcuacauugcccguauacgacacuauaaaauacuacuccaucaucccucacucaauuagaucuauacaaucagaucgaaaagcaugggccgcauucuauguguacaaauuacaaccauuaaccuucuuacucgacuucuccguagacggcuacauacguagagcaauagauugcgguuucaaugaucuaagccaacuacauugcucauacgaauccuuugauguagaaucaggagucuacagcgucucaucuuuugaagcaaaaccuuccggaucaguuguugaacaagcugaaggggucgaaugugauuucuccccacuauuaaguggaacucccccucaaguauacaacuucaauagacucguauucaccaauugcaauuacaacuuaacuaaauuauuaucgcuuuucucaguaaacgacuuuaccugcucacagauauccccugcugcaauagcauccaacuguuauucaucacucauauuagacuauuuuuccuauccauuaagcaugaaaucagaccuaaguguaucaucugccgguccuauaagccaauucaauuauaaacaauccuucuccaacccuacgugccuaauauuagcaacuguaccacacaauuuaacaacuauaacuaaaccauuaaaauacucuuacauaaacaaauguucccgcuuacuuucagaugaucgaacagaaguuccacaacugguaaaugcaaaucaauauucuccauguguaucaaucguuccuucaaccguaugggaagauggcgauuacuauaggaaacaauuaucaccucuugaagguggaggaugguuaguagcaucaggcaguacagucgcaaugaccgaacaacuccaaaugggauucggaauaacuguacaauauggaacugauacaaacucaguuugccccaaacuagaauuugcuaaugauacuaaaauagcuucucaauuaggaaauuguguagaauauagcuuauaugguguuucuggaagaggaguauuccaaaacugcacagcugucggcguaagacaacaaagauuuguauaugacgcuuaucagaauuuaguaggcuauuauagcgaugacggaaauuauuauugccuucgagccugcguaucagucccuguuucaguaauauacgauaaagaaaccaaaacccaugccacacuauuugggucagucgcaugcgaacauauuucaucaacaaugucacaauauucgcguuccacuagauccaugcuuaaacgucgagauagcacuuauggcccacuacaaacgccaguaggauguguuuuaggacucguaaauucaaguuuauucguagaagauuguaaauuaccccucgggcaauccuuaugcgcgcucccagauacaccaucuacccuaacuccuagaucuguucgaaguguacccggugaaaugagacuagcgucaauagcuuuuaaccaccccauacaaguagaucaacuaaacucuucauacuuuaaacuaucaauaccuacgaauuucagcuuuggcguuacacaagaauacauucaaacaacgauccaaaaaguuaccguagacugcaaacaauacgucugcaauggauuccaaaaaugugaacaacuauuacgagaauauggucaguucugcucuaaaauaaaccaagcauuacacggugcaaauuuacgccaagaugauagugucagaaaccuuuucgcaucagugaaaucuagucaaucuucaccaauuaucccugguuucggaggagauuucaaucugacacuucuugaacccguuuccaucuccaccgguucgcgcucagcucguucagcaauagaagacuuacuauucgacaaaguaaccauagcugauccuggguacaugcaaggauaugacgacuguaugcaacaagguccggcuagugcuagagaccucauaugcgcccaauaugucgcaggguauaagguacugccacccuuaauggauguuaacauggaagccgcuuacacgaguagucuccuuggaucuauagcuggugucggauggacugcaggacuaucaaguuuugcagcgauucccuucgcacaauccaucuuuuacagacuaaacggggucgguauuacucaacagguccucucugaaaaucaaaaacucauagccaacaaauuuaaucaagcccucggagcaaugcaaaccggauuuaccaccacaaaugaagcauucagaaaaguucaagaugcaguaaauaauaacgcacaagccuugucaaaguuagcuucagaacucaguaauacauuuggagccaucucagccucaaucggcgauauaauacagagauuagacguuuuagaacaagaugcacaaaucgaucgacucaucaauggaagacuaacaacccuaaaugccuuuguagcccaacaacugguuaggucugaauccgccgcucuaagcgcucaacuugcaaaagacaaaguuaacgaauguguaaaagcacaaucgaaacgauccgguuuuuguggacaagguacccauauaguuuccuuugucguaaacgcgcccaaugggcuauacuucaugcacguugguuacuaccccaguaaucauaucgaaguaguaucagcauauggauuaugugacgcugccaacccaacaaacuguauagcaccugucaacgguuacuuuauaaaaacaaacaauacccguauuguagaugaauggucauauacaggaucaucauucuaugcuccagaaccuauuacaucgcucaacacaaaauaugucgcaccccaagucacauaccaaaauauaucaaccaaucuacccccuccccuauuaggaaauucaacaggaauugacuuucaagacgaacucgacgaguucuucaaaaacguuaguacauccauuccgaauuuuggaucauuaacucaaauaaauaccacauuacuagaucuaacauaugaaaugcucucuuuacaacagguaguaaaggccuuaaacgaaucauacauagauuuaaaagaacuuggaaacuacacguauuauaauaaauggcccugguauauauggcuaggauuuauugcuggccuagucgcauuagcacucugcguauucuuuauccuauguugcaccggaugugguacaaacugcaugggcaaauuaaaauguaauagguguugugaucguuaugaagaauacgaccucgaaccucauaaaguccacguacacuaa

SEQ ID NO: 1141 - RNA, 4062 nt, Artificial Sequence
  derived and/or modified CDS sequence (opt6) from MERS-CoV__AHY22555__S
augauacauucagucuuucuacucauguuuuuacuuacaccuacggaauccuauguugacguuggaccugacucuguuaaaucagcuuguauagaaguugauauacaacaaacauucuuugauaaaacauggccccgccccauagacguaagcaaagcagacgguauaauauauccacaaggaagaacauacagcaauauaacgaucacguaucaaggacuuuuuccauaucaaggagaucacggcgauauguauguauauucagccggacaugcuacaggaacuacaccccaaaaacucuuugucgcuaacuauucccaagauguuaaacaauucgcuaauggguucgugguaagaaucggugcagcagcuaauagcacuggaaccguaauaaucucgccguccacuuccgcgaccauacgaaaaauauacccugccuuuaugcuuggauccuccgucggcaauuuuucagacggaaaaaugggacgauucuuuaacuauacauugguuuuacuuccagacggaugcggaacacuucuucgugcauuuuauuguauacuggaaccucgaucaggaaaucacugcccagcaggaaacuccuacacaaguuuugcaacauaucauacuccagcaacagauuguucugauggcaauuauaauagaaacgcuucgcucaauagcuuuaaagaauacuucaaucuacgaaauuguaccuuuauguauacuuauaauauaaccgaagaugaaauuuuagaaugguucggcaucacccaaacagcacaagguguccaccuuuuuagcuccagguaugucgaucuuuacgguggcaauauguuucaguuugcaaccuuaccuguauaugacacuauuaaauauuauucuaucaucccacauaguauccgcucaauucaaucugauagaaaagcaugggcgucauuuuauguauauaaacuacaaccacuaacuuucuuauuagauuuuucugucgacggcuacauccggagggcaauagauuguggauuuaaugaccuaucucaacuucacugcuccuacgaaaguuucgacguagaaucagguguuuauuccguuuccaguuucgaagcuaaaccaagugguucuguaguagaacaagccgaagguguagaaugugacuuuucuccccuacucuccgguacaccgccucaagucuauaacuucaaaagacuuguauuuacuaacugcaauuauaaccuaacaaaacuauuaucccucuucuccgucaaugacuuuaccugcucacagaucucccccgcagcaaucgcaucgaauuguuacaguuccuuaauccuagauuacuuuucguauccucuuucuaugaaauccgaccuauccguaucuucagcgggcccaauuucucaauucaauuauaaacaauccuuuuccaauccaaccugucuaauacuugcaaccguuccacauaacuuaacgacaauaacaaaaccauuaaaauauucuuacauaaacaaaugcucaagacuucugucagaugauagaacagaagucccccaauuaguaaauagcaaucaauauucgccuugcgugaguauuguaccaucaaccguaugggaagauggagacuacuauaggaaacaacuaucaccucucgaaggaggaggauggcuaguagcuucggggaguaccguagcaaugacugaacaacuccaaaugggcuuuggcauaacuguccaauauggaacagauacuaacucaguuuguccaaaacucgaauuugcaaaugacacgaaaauagcaucccaauuaggaaauugcguugaauauucucuuuauggcguuucggguagaggaguauuucaaaacugcacugcaguuggaguacgucagcaacguuucguauaugaugccuaucaaaaucucguagguuacuacucagacgacggcaauuauuauugcuuaagagcuugugucucaguaccuguuucaguaauuuacgauaaagaaacaaaaacacaugcaacacuguucgguaguguagcaugcgaacauauaaguuccacuaugucucaauacucaaggaguacaagaucaaugcucaagaggcgagauuccacuuauggcccucuacaaaccccuguaggauguguccuuggauuaguuaacucaagccuauuugucgaagacuguaaacuaccucuaggacagucacuaugcgcacuucccgauacaccaucaacauuaacccccagaucaguccguucagucccaggcgaaaugcgccuggcaaguauugcuuucaaccacccaauacaaguagaucaacucaauuccuccuauuuuaaauuaagcauuccaacaaacuuuagcuuuggaguuacacaagaauacauucaaacaacaauacaaaaaguaaccguagacuguaaacaauacguaugcaacggauuucaaaaaugcgaacagcuucuccgagaauauggucaauuuuguucaaaaauaaaccaggcauuacauggugcuaacuugagacaggacgauuccguaagaaaccuauuugcaucaguaaaaaguucacaauccagcccaauaaucccuggcuuuggcggugauuuuaaucuaacccuucuugaacccguuucuauuagcacaggaucgcgaucugcuagaagugccauugaagaucuccuauucgauaaaguaacaauagcagacccaggauacaugcagggauacgaugacuguaugcaacaaggcccagcgucagcccgugaccuuauuugcgcacaauauguagcgggauacaaaguacuacccccucuuauggacguaaauauggaagcggcauacacaaguagucucuuaggaucaaucgccggaguaggguggacugcugguuugucgucauuugcagcuauaccauucgcacaaucaaucuucuaccgauuaaacgggguaggaauuacacaacaaguuuuauccgaaaaucaaaaacuaaucgcaaacaaauuuaaccaagcucuaggagcaaugcaaacaggauucacgacaacuaacgaagcauuucacaaaguucaggaugcaguuaauaauaaugcucaagcauuaucuaaauuggccucugaauuaucaaacacuuuuggcgcaauaucagcuuccauaggagacauaauccaaagauuagacguccuagaacaagacgcacaaaucgacagauuaauaaauggaagauuaacuacuuuaaacgcauucgucgcccaacagcuuguaagaucugaaagugcagcacuuagcgcgcaacucgccaaagauaaaguaaaugaauguguaaaagcucaaaguaaaagaucaggauuuuguggccaagguacgcauauagucucauucguugucaacgcaccuaacggguuauauuuuaugcauguagguuacuacccaucuaaccacaucgaaguaguaucagcauauggucuaugugacgccgcgaaucccacgaauuguauagcaccaguuaauggguauuuuaucaaaacaaauaacacuagaauaguagacgaauggucauacacagguucgucauuuuaugcccccgaaccaaucacaucauuaaauacaaaauacguggccccucaaguaaccuaucaaaauaucucgacuaaucuaccaccgccccuucucggaaauucaacgggcauugacuuucaggaugagcuagaugaauuuuucaaaaauguuaguacaucuauuccaaacuucggaucacucacacaaauaaauacaacauuauuagaucuuacauaugaaauguuaaguuuacaacaaguaguuaaagcacuuaacgaaucuuacauagauuuaaaagaauuaggcaauuacacuuauuauaauaaauggcccugguauauuuggcuuggauucaucgcaggucucguagcauuagcgcuauguguuuucuuuauuuuaugcugcacaggaugugguacaaacuguauggguaaacucaaauguaauagauguugugacagauaugaagaauaugaccucgaaccacauaaaguacauguacauuaa

SEQ ID NO: 1142 - RNA, 4062 nt, Artificial Sequence
  derived and/or modified CDS sequence (opt6) from MERS-CoV__AHY22565__S
augauacacucuguauuucuauuaauguuccuuuuaacaccaacagaauccuauguugauguugguccugauucggugaaaucggcuuguaucgaagucgacauacaacaaacauucuucgauaaaacauggcccaggccaaucgaugucuccaaagcagaugggauuauuuacccucaaggcaggaccuauucgaauaucacaauuaccuaccaaggacucuuuccauaccaaggagaucacggcgauauguacguguacucagcaggccacgccacaggaacaacaccgcaaaaacuauucguagcaaauuacucccaagauguuaaacaauuugcaaauggcuucgucguacguauaggugcagccgcaaauuccacuggaacaguuauaaucucacccagcacuucugccauaauccguaaaauauauccugcauucaugcuagggucuuccguaggcaacuucucagacggaaaaaugggacgauucuuuaaucauacccuaguuuuauuaccagacgguugcgguacucuucuuagagcuuuuuauuguaucuuagaaccccgcucaggcaaccauuguccagcagguaauucauauacuucauucgcaacuuaucauaccccagccacagauuguucugauggaaacuacaaucguaacgcuaguuugaauagcuucaaagaauauuucaaucuacguaacugcacuuuuauguacacauauaauaucaccgaagacgaaauacuugaaugguucggaauaacacaaaccgcccaaggcguacauuuauuuagcucccgauauguagaccucuaugguggaaacauguuucaauucgcuacacuaccaguuuaugauacaaucaaauacuacucuauuauuccucauuccauacguucaauucaauccgauagaaaggcaugggcgucauuuuauguauauaaauuacaaccauuaaccuucuuacuagacuuuucugucgauggauauauacgacgcgcaauagacugcggauuuaaugacuuaucucaauuacacuguucauaugaaucauucgauguagaaaguggcgucuacaguguuucaaguuuugaagcaaaaccaagcgguagugucguagaacaggcagaaggaguagaaugugacuuuucaccacuacuaagugguacuccuccacagguguauaauuucaaaagacuugucuucacaaacugcaauuauaaccuaacuaaacuucuaucacucuucucagucaacgauuuuacauguucccaaaucagcccagcugcaauagcuaguaauugcuacucaaguuuaauauuagauuacuucucuuauccccuuucuaugaaaucagaucuaucuguuucaucagcaggacccauaucucaauucaacuauaagcaaaguuuuaguaauccaacaugucucauacucgccacaguuccgcauaaucuaacaaccauuacaaaaccccugaaauacucauauauaaacaaauguucacgccuauuaucagacgacagaacagaaguaccacaauuaguaaacgcgaaccaauacucaccauguguuaguauuguuccaucaacaguaugggaagacggugacuauuaucgaaaacaguuaucuccuuuagaagguggaggguggcuuguagcaucaggaucaacaguagccaugacagaacaauuacaaaugggauuugggauaacuguccaauauggaacugacaccaauagcguaugucccaaauuagaauuugcuaaugacacaaaaauugcuucucaacuuggaaauugcguagaauacucucuauauggugucucaggccggggaguauuccaaaacuguaccgcaguuggagucagacaacaaagauuuguauaugacgcuuaccaaaaucuaguaggauauuacucagacgauggaaauuauuauugcuuaagagcaugcguuaguguaccaguaaguguaaucuaugauaaagaaacaaaaacacaugcaacuuuauucggcucagucgcuugugaacauauaucuucgaccaugucacaauauucaagaucuacaagaucaaugcuaaaacgacgugacucaacuuaugguccuuuacaaacuccaguugguuguguacuaggucucguuaauucaucucuauuuguggaagauugcaaacucccauuaggacaaucuuugugugcccuuccugacacaccuucuacucuuacacccagaucaguccgaucaguacccggggaaaugcgucuagcgucaaucgcuuuuaaucacccaauacaaguugaccaauuaaauucuucuuacuuuaagcuaaguauaccuacuaauuuuucauuuggaguaacacaagaauauauucaaacaacaauacaaaaaguaacaguugauugcaaacaauacgucuguaauggauuccaaaaaugugaacaauugcuaagagaauauggucaauucuguucuaaaaucaaucaagcacuacacggugccaacuuacgccaggaugauaguguacgaaaucucuucgcaagcgucaaaucgagccaauccuccccaauuauaccagguuucgguggagacuucaaucuuacauuguuagaacccgucagcauaagcacaggaaguagauccgcgagaucagcaaucgaagaucuacuauucgauaaaguaacaaucgcagaccccggauauaugcaagguuacgaugacugcaugcaacaagggcccgccuccgcaagagaccuuauaugugcccaauauguagcuggguacaaaguacucccaccgcuuauggauguaaacauggaagcagccuacacuucauccuuauuaggcucaaucgcaggcguuggauggaccgcaggucuauccucuuuugcagccauaccauuugcacaaucaauauucuacagauugaacggcgucgguauuacacaacaagucuuaucugaaaaucaaaaacuaauagcgaauaaauuuaaccaggcccuaggugccaugcaaaccggauuuaccacuacaaaugaggcuuucagaaaaguucaagacgcuguaaauaacaaugcacaagcauuauccaaacuagccagcgaauuguccaauaccuucggcgcuaucuccgcaucaauuggagacauaauccaacgacuagauguacuugaacaagacgcacaaauugaucgacuaauaaauggucgucuaacaacguuaaacgcuuucguagcccagcaauuaguacgcuccgaaagcgccgcacuauccgcccaacucgcaaaggauaaaguaaacgaauguguuaaagcucaaucgaaacgauccggauuuugcggccaaggaacccauauuguuucuuucgucgucaaugcaccuaaugguuuauacuucaugcacguagguuacuauccaucaaaucauauugaaguagucagugcauacggauuaugcgacgcaucaaauccgacuaacuguauugccccugucaauggcuacuuuauaaagaccaacaauacccgaauagucgaugaauggucuuauacaggaaguagcuuuuacucaccugaaccuauuacgucuuuaaacacaaaauacgucgcaccucaaguuacauaucaaaacauauccacaaacuuaccgccaccacuccuuggcaacuccacaggaauagauuuucaagacgaauuagaugaauuuuucaaaaauguuucaacaucuauuccuaacuucggcagccucacccaaaucaauacaaccuuacuagaccuaacauaugaaaugcuaucacuucagcaaguaguaaaagcucuaaaugaaucauauauagaccuaaaagaacuaggaaacuauacauauuauaauaaauggccaugguacaucuggcuugguuuuauagcuggacucguagcgcuagcccuaugugucuucuuuauucuaugcuguacagguuguggcacuaacuguaugggaaaacugaaauguaauagaugcugugauagauaugaagaauaugacuuagaaccacacaaaguucacguucauuaa

SEQ ID NO: 1143 - RNA, 4062 nt, Artificial Sequence
  derived and/or modified CDS sequence (opt6) from MERS-CoV__AJG44069__S
augauacacagcguauuuuuacuuauguuucuauuaacaccuacagaaucuuauguugauguaggaccagauuccguuaaaucagccugcauugaagucgauauacaacaaaccuuuuucgauaaaacuuggccucgaccaauagacguuucaaaggcagauggcauuauuuauccacaagggaggacauauucuaauaucacaauaacauaucaaggacuauuuccauaucaaggagaccauggcgacauguacguguacagcgcuggucacgcaacaggcacuacgccucgaaaacuuuuuguagccaacuauucacaagaugucaaacaauuugcuaaugguuuuguaguccgaauuggugccgcagcaaauucaacaggcacugucauaauuucaccuagcacauccgcaacaauaagaaaaauauauccugcguucaugcugggcuccucugucggcaauuuuagcgacggaaaaaugggacgguuuuucaaccacaccuuaguacuguuacccgaugguuguggcacuuuguuaagagcguucuauugcauauuagaaccuagaucuggcaaucacugcccagcgggaaauucauauacaaguuuugcaacauaccacacacccgcuacggacugcucagauggaaauuauaaucgaaaugcuucauuaaauagcuuuaaagaauacuuuaacuuaagaaauuguacauucauguauacauacaauauaaccgaggacgaaauauuggaaugguuuggcauuacacaaaccgcacaagggguccaccuauucagcucaagauauguagauuuauacggaggcaacauguuccaauucgcaacccuccccguauacgacacgauuaaauauuauucaauuauaccucauuccauaaggucaauccaaucugaccguaaggcuugggcagcauucuauguuuauaaauuacaaccacuaacauuccuacuugauuuuucaguugaugguuauauccgacgugcaaucgacugugguuuuaaugaucuuucucaauuacauuguucauaugaaucauuugauguagaaucaggcguuuauucgguaaguuccuucgaagcuaaaccaucugguagcguaguagaacaagcagaagguguugaaugcgacuucuccccuuuacuuucaggaacacccccucaagucuacaacuuuaaacgacucguauuuaccaacuguaauuauaaucucaccaaacugcuaucccuauuuucaguuaacgauuuuacaugcucacaaauaagcccugcggcaauagccucaaacugcuacucaaguuuaauacuagauuauuuuuccuauccuuuaucgaugaaaucagaucuaucuguaucgucugcaggaccuauaucacaguucaacuauaaacaguccuucucuaauccaacaugucuaauccucgcaacaguaccucauaauuuaacuacuauaaccaaaccauuaaaauacucuuauauaaacaaaugcucccguuuacuaucagaugauagaacugaaguaccacaauuaguuaacgcaaaccaauauaguccaugcguaaguauaguuccuucuacaguaugggaagacggggacuacuaccguaaacaacuauccccauuagaaggcggagguuggcuaguugcaucuggcucuacaguugcuaugacagaacaacuacaaauggguuuuggcauaacgguccaguauggaacagacacaaauucaguuuguccuaaauuagaauuugcaaacgauacaaaaaucgcaucccaacucgggaauuguguagaauauuccuuauauggaguaucuggaagaggagucuuucaaaauugcacagcaguaggaguacgacaacaacgauucguuuaugacgcauaccaaaaccucguaggcuacuauucugaugauggcaacuauuauugucuacgggcauguguuucugucccaguaucagucaucuaugacaaagaaacaaagacucaugcuaccuuauucggaucuguggcaugcgaacauaucucuaguacaaugucucaauacucaagaucaacaaggucuaugcuuaaacguagagauucaacuuauggaccacuacaaaccccuguaggcuguguccucggauuaguuaauaguucuuuauuuguugaagauuguaaacuaccacuaggucaaagccuuugcgccuuacccgauacuccuucaccucuaacaccucgcucaguuagaucaguuccaggagaaaugagacucgcuagcauugcauuuaaccauccaauucaaguagaccaacuaaauagcagcuacuuuaaacuaucuaucccuacgaauuuuagcuucggaguaacucaagaguacauccaaacaacaauucaaaaaguaacaguagauuguaaacaauauauaugcaauggauuucaaaaaugugaacaauuacuucgcgaauauggacaauucugcuccaaaauuaaucaagcucuacacggagcaaauuuaagacaagacgauucaguucguaaccucuucgcaucuguaaaaucaucacagucaucaccuauuauccccggauucggcggagauuuuaaucuaacuuugcuagaacccguuucuauuucaaccggaucaagaucagccagaagugcaauagaagaucuucucuucgauaaaguuacaauagcugauccagguuacaugcaaggauaugacgacuguaugcaacaaggacccgcgagugcucgugaccuaauaugugcacaauaugucgccggcuauaaaguacuucccccucucauggacgugaauauggaagcugcauauaccucuucccuccuaggaucuauugcuggagucggcuggacugcaggacuaucuucauucgcugcaauuccauuugcucaaaguauauuuuaccgacuaaaugguguaggaauuacacaacaagucuuaucagaaaaccaaaaauuaauugcgaauaaauucaaucaagcgcuuggcgccaugcaaaccggauucacuaccacaaacgaagccuuuagaaaaguccaagaugcuguuaacaauaaugcacaggcgcuaucgaaacuagcaucagaacuauccaauacuuucggugcaauauccgcuucuauuggagacauaauacaacgcuuagacguguuagaacaggacgcgcaaaucgaccgauuaauuaauggaagguuaacaacauuaaaugccuucguagcucaacaauuaguaagaucugaaucagcagcacuuuccgcccaacuagcaaaagacaaagucaaugaaugcguaaaagcccaaucuaaaagaucuggauuuuguggucaagguacucacauagucuccuuuguaguaaacgcucccaauggccuauacuucaugcacguuggauacuacccuucaaaucauauagagguuguaucagcauacggauuaugcgacgcagcaaauccgacaaacuguauagcaccagucaacgguuauuuuauaaaaacaaauaauaccaggauagucgaugaauggaguuauacaggauccaguuucuauucuccggaaccaauaacuucuuuaaauaccaaauauguagcuccucaaguuaccuaccaaaacauauccaccaacuuaccaccaccauuacuuggaaacuccacagguauugacuuccaagaugaacuggaugaguucuuuaaaaaugucucaacuucuaucccaaacuuuggaucacuaacacagaucaauaccacacuuuuagaucucacauacgaaauguuaucauuacaacaaguuguuaaagcucugaaugaaagcuauauugaucuaaaagaacucgguaauuacaccuacuauaacaaauggccaugguacauaugguuaggauuuaucgcgggccuaguagcacuagcgcuaugcguauucuuuauacuaugcuguaccggauguggcacuaauuguaugggcaaguuaaagugcaaccgauguugugaucgcuacgaagaauacgacuuagaaccucauaaaguacacguccacuaa

SEQ ID NO: 1144 - RNA, 4062 nt, Artificial Sequence
  derived and/or modified CDS sequence (opt6) from MERS-CoV__AJG44080__S
augauacacagugucuuccuuuuaauguuccuacuaacuccaaccgaaagcuauguugauguuggcccagacuccguaaaaucggccuguaucgaagucgacauucaacaaacuuucuuugacaaaacauggccacgccccauugacguaucaaaagccgaugguauaauauacccacaaggaagaacauacagcaauauaacaauuacuuaccaaggucuuuucccauaccaaggagaccauggagacauguauguuuauucagccggucaugcuacaggaaccacaccacaaaaacuauuugucgccaacuauucacaagauguaaaacaauucgcuaacggauucguaguccgcauuggagcagcugcaaacucaacugggaccguuaucauaucuccauccacaagugcaaccauacguaaaaucuauccagcauucauguuaggaaguucagucggaaacuuuucagacggaaaaaugggacgauuuuucaaccauacacucguccuacuaccagaugguuguggaacacuauuaagagcauuuuauuguauucuugaaccaagaagcggaaaccauugcccagcaggcaacaguuacaccuccuuugcaacauaccauacaccagccacagauuguucagacggaaauuauaacagaaaugccucacuuaacucuuuuaaagaauauuucaaccuaagaaauuguacauucauguacacauauaauauuacugaagacgaaauacuagaaugguuuggcauuacacaaaccgcucaaggcguccaucucuuuucaucccgcuacguagaucucuauggagggaauauguuccaauucgcuacacuaccaguauaugacaccauaaaauacuacuccaucauuccacauucuauuagaucgauaaaaucugaucgaaaagccugggccgccuuuuauguuuauaaauuacaaccauuaacuuuucuccuagauuucagugucgauggauauauccguagagcaauagacugugguuuuaacgaucucagucaacuucauuguaguuaugaaucauuugacguagaaucaggaguauacucaguauccucauucgaagcaaaacccucaggaaguguaguagaacaagcagaaggcguagaaugugauuuuucuccccuucuuucagguacacccccgcaagucuacaacuuuaaaagacucgucuucaccaacugcaauuauaauuugaccaaacuacucucuuuauucagcgugaacgauuucacaugcucucaaauaucucccgcagcuaucgcaucaaauuguuacuccucacuuaucuuagauuacuuuagcuauccguuaucaaugaaaucggauuuaucaguaagcuccgcgggaccaauaagucaauucaauuauaaacaauccuucagcaacccaacuugcuuaauucuugcuacaguuccacauaaucucacaacaauuaccaaaccauugaaauacuccuauauuaauaaauguucaagacuacuuuccgaugauagaacugaaguaccacaacucguaaaugcaaaucaauauucaccuuguguuucaauaguuccuucaacuguaugggaggacggggacuauuacagaaaacagcuaucuccauuagaaggcggaggaugguuagucgcuucaggauccacagucgcuaugacagaacaacuccagaugggauuuggaauaacuguacaauacggaacagauacuaacucaguuugcccaaaauuagaauuugcuaaugacacgaagaucgcaagccaacuaggaaauugcguagaauauagcuuauauggaguuucaggcagagguguauuccaaaacugcaccgcagucgguguacgacaacaaagauucgucuaugaugccuaucaaaaccuaguuggcuauuauucagaugacgguaauuacuacuguuuaagagccugcguaucaguuccagucucuguaauauacgacaaagaaacaaaaacccaugcuacacuauuuggaucaguugcuugcgaacauauuaguaguacuaugagccaauacucucguucuacaagauccauguuaaaacguagagauucuacauauggccccuuacagacuccaguagggugcguacuagguuuagucaauucuucacuauuuguugaggacuguaaacuccccuuaggucagagucuuugugcauuacccgacacuccaucuccccugacuccaagguccguucgcagugucccuggagaaaugcgucuagcaucaauagcauucaaccauccaauucagguugaucagcucaauagcuccuacuuuaaacuuucuauuccaacaaacuucucauuugguguaacacaagaauauauucaaacuacuauacaaaaagucaccguagauugcaaacaauacauauguaacggauuccaaaaaugcgaacaauuacuaagagaauacggccaauuuuguucaaaaauaaaucaagcucuacauggugcaaaccugagacaagaugacucagucagaaaccuauuugcaaguguuaaaucaucacaaaguucucccauaauaccaggauucggaggcgauuuuaauuuaacacuauuagaaccugucucuauaucaacagguucacguagcgcuagaucagcaaucgaagaccuccuauucgauaaaguaacuaucgccgauccuggauacaugcaaggguaugaugacugcaugcaacaagguccugccagcgcacgugaucuuaucugcgcacaauacgucgccggauacaaagugcuacccccauuaauggacguaaauauggaagcagcuuacacaucuucucucuuaggcucgauugcgggcguaggcuggacugcaggauuaaguuccuucgcugccauuccauucgcacaaagcauuuucuacagguuaaacggaguaggaaucacccaacaaguacuaucagaaaaucaaaaacuaauugcuaacaaauucaaccaagcccuaggugcaaugcaaacaggauucacaacaacuaacgaagccuuccgaaagguacaagaugccguaaacaauaaugcacaagcccuaaguaaauuagcuucagaacuaucuaauacauucggagccaucucagcuucaauaggggauaucauacaaagauuagacguauuagaacaggaugcacaaauugacagacuuauaaauggaagacugacaacauuaaaugcauuuguagcucaacaguuaguucgcuccgaaucugcagcauuaucugcccagcuagccaaagauaaagucaaugaaugcguaaaggcucaauccaaaagauccggauucugcggucaagguacccacauagucaguuuuguaguuaacgcccccaacggucuauauuuuaugcauguuggauacuauccauccaaccauauagaagucguuagcgccuauggacugugugaugcugcuaauccaaccaauuguauagcaccaguuaacggauacuuuauaaaaacaaauaacacacgaauaguugacgaauggagcuauacaggcucaucguuuuauucaccugaaccuaucacaucuuuaaacacuaaauacguagcaccacaaguaacauaucaaaacauaucaaccaaccuacccccuccauuacuugguaauucuacagguauagauuuucaagaugaacucgacgaauuuuucaaaaauguuucaacaucaauaccaaauuucggaagccuuacacaaauuaauaccacucuacuggaccuaacauacgaaaugcucucucuccaacaaguaguaaaagcucuuaaugagagcuacauagaucucaaagaguuaggaaacuacacuuauuacaauaaauggccgugguauauuuggcuaggauucauagcaggacucguggcucuugcacuauguguuuucuuuauacucuguuguacaggaugcggaacaaacugcaugggaaaauuaaaaugcaaucgauguugugacagauaugaagaauaugaucuugaaccucauaaaguacauguacauuaa

SEQ ID NO: 1145 - RNA, 4062 nt, Artificial Sequence
  derived and/or modified CDS sequence (opt6) from MERS-CoV__AJG44102__S
augauucauuccguauuucuccuaauguucuugcucaccccaaccgaaaguuaugucgauguaggcccagacagcguuaaaucugcauguauagaaguagacauacaacaaacauucuucgacaaaaccuggccacgcccaaucgacguaagcaaagcagauggaauuaucuacccacaaggacgaacauacucuaauauaacaaucacauaccaagguuuauucccuuaccaaggagaucacggagacauguacgucuacagugcuggucacgcuacuggaacuaccccucaaaaacuauucguagccaauuacucccaagaugucaaacaauuugcaaacggauucguaguucgcauaggagccgcagcaaacuccacaggcacaguaauaauuucaccgucgaccagugcgacuauacguaaaauauacccggcauucaugcuaggcucaucaguuggaaacuucuccgacgggaaaaugggacgauuuuucaaccauacucucguucuuuuaccagaugguuguggcaccuuauuacgagcauucuauuguauacuagaaccccgauccggaaaucacuguccugcaggaaauaguuacacauccuuugcaacauaucacacuccugccacggacuguuccgacgguaacuauaacagaaacgcaucgcuaaauagcuuuaaagaauacuucaaucuaagaaacugcaccuucauguauaccuauaauauuacagaagacgaaauacucgaaugguuuggaauaacgcaaacagcacaagguguucauuuguuuucuucaagauauguagaccucuauggcggcaacauguuucaauuugcuacccucccaguauacgauacaauaaaauacuacaguauuauuccacacuccaucagauccauccaaucagaucgcaaagcaugggcggcauucuauguauauaaacuucaaccacucacuuucuuacuggauuucuccgucgacggauauaucaggagagcaaucgauuguggauuuaaugauuuaucacaauuacacugcuccuacgagagcuucgacguagaaucaggagucuauucaguuucuagcuuugaagcaaaaccaucaggcuccguaguagaacaagcagagggugucgaaugugauuucucuccucuuuugaguggcacaccaccacaggucuauaacuuuaaaagauuaguauucacuaauuguaacuacaaucuuacaaaauuacuuucuuuauucagugucaacgauuuuacaugcucucaaaucucuccugccgcaauagcauccaauuguuauagcucguuaauucuagauuacuuuucuuauccuuuaucaaugaaaucagauuuaaguguuucuucagcuggcccuauaucucaauuuaauuauaaacaaucuuucucaaauccuaccugccuaauuuuagcaaccgucucucacaauuuaacaacaauaacaaaaccacuaaaauauucuuacauaaacaaauguucaagauuacuaucagaugauagaacagaaguaccccaacuuguuaaugcaaaucaauauucgccaugcguuucaaucgucccuucuacaguuugggaagauggugauuacuauagaaaacaauuaucuccacuagaagggggaggaugguuaguagccucuggaucaacuguugcuaugacagaacaauuacagauggguuuuggaaucaccguacaauauggcacugauacaaauuccguaugucccaagcucgaauuugccaacgacaccaagauugcuucgcaguuaggcaacugcguagaauauucccucuacggaguaaguggcagaggaguauuucaaaacuguacagccguaggaguucgccaacaaagauucgucuacgacgcauaucaaaaucuaguugguuacuacucagacgacggaaauuacuauugucuaagggcauguguuucggucccuguaucuguuauauacgauaaagaaacuaagacacacgcgacacuauuuggaaguguagcuugcgaacacauaucaaguaccauaucacaauacuccagaucuacucguuccaugcuaaaaagacgagauucuacguacggaccccuacaaacuccaguagguugcguucuuggucuuguuaauucuuccuuauuuguagaagauugcaaacuuccauuaggucaaucucuuugugcuuuacccgacacacccucuacucuuaccccgagaagcguccguuccguaccaggcgaaaugagacuugcaagcauagcauuuaaccacccuauucaaguagaucaacuaaauucgucguacuuuaaacugucaauaccaacuaacuuuucuuucggaguaacacaagaauauauucaaacgacuauacaaaaaguuacuguagauuguaaacaauauguuuguaacggauuccaaaaaugugaacaacuccuaagagaauauggucaauucuguucuaaaauuaaucaagcucuacauggagcaaacuugaggcaagaugauucuguacgaaaucuauuugcgucuguuaaaucaucacaaucaaguccuauaauaccugguuucggaggagauuuuaacuuaaccuuauuagaaccagucaguaucucaacuggaucgagaucagcaaggucugcaauagaagauuuauuauuugacaaaguaacaauagcugaucccggauacaugcaaggauaugaugacuguaugcaacaaggcccggcaucagcaagagauuuaauuugcgcccaauacguugcagguuauaaaguacuuccaccacucauggacguuaacauggaagcugcuuauaccucaucucuuuuagguucaauagcuggaguuggauggacagcuggacuauccucauuugcagcaauaccuuuugcccaaagcauauuuuaccgauuaaauggaguaggaauuacccaacaggucuuaucugaaaaucaaaaacuaauagcuaauaaauuuaaccaagcauuaggugcuaugcaaacuggcuuuacuaccacuaacgaggcuuuuagaaaaguccaagaugccguaaauaauaaugcucaggcuuuaucaaaauuagcaagcgaacuguccaauaccuuuggagcuauaucagcaucgauaggagauauaauccaaagauuagauguacucgaacaagaugcccaaaucgauagacuuauuaauggacgacuaacuaccuuaaaugcauucguagcacaacaauugguacgaucagaaucagcagcacuuuccgcucaacucgcaaaggauaaaguuaaugaaugcguaaaggcacaaucuaaaaggucuggauucugcggucaaggcacccacauuguuucauucguuguaaaugccccaaauggacuauauuucaugcacguaggauacuacccaucuaaccauaucgaaguaguaucagcauauggacucugugaugcagccaauccuacaaacugcauugcuccaguaaacggauacuucauaaaaacaaauaauacaagaaucguggaugaauggucuuauacaggaucaucuuuuuacucacccgaaccuauaacgagcuuaaacacaaaauaugucgcaccucaaguuacuuaccaaaauauaucuacaaacuuaccacccccauuauuagguaauucaacuggaauagacuuucaagacgaacuagaugaauuuuucaagaacgucaguacuucuauaccaaauuucggaucauugacacaaauuaacaccacauuauuagaucuaacauaugaaauguuaucauuacaacaagucguuaaagcacuaaacgaaucauauauagaccuaaaagaauuaggaaauuacacauacuacaacaaauggccaugguauaucuggcuaggauuuauagcuggccuuguugcacuugcacuauguguauucuuuauauuguguuguacuggaugcggaacaaauugcaugggaaaacucaaaugcaaucgcuguugcgacagguacgaagaauaugaucucgaaccccauaaaguacacgugcauuaa

SEQ ID NO: 1146 - RNA, 4062 nt, Artificial Sequence
  derived and/or modified CDS sequence (opt6) from MERS-CoV__AJG44124__S
augauccauaguguauuccuacuuauguuuuuacuaaccccuacagaaucuuacgucgauguaggucccgacuccgucaaaucugcuuguauagaaguagacauacaacaaacauuuuucgacaaaacuuggccccguccaauagauguaucaaaagcagauggaauaaucuacccccagggccguaccuauucuaauaucaccauuacauaucaagguuuauuuccuuaucaaggcgaucauggugauauguauguauacucagcaggccaugcaacaggcacaacaccucaaaaacucuucgucgccaacuacucacaagaugucaaacaauuugcaaacggauucguugugcgaauaggagcugccgcaaacucaacaggaacaguaauaauaucaccuucuacuucugcaacaauaagaaaaauauacccagccuucauguuaggcaguuccguaggcaauuuuucugauggaaaaaugggaagguucuuuaaccacacacucguacuuuuaccugaugguugcgguacucuuuuacgugccuucuauuguauacuugaaccuagaagugguaaucauuguccugcgggcaauuccuacacaucuuucgcaacguaccauacacccgcgacagacugcagugacggaaauuacaaucggaaugccucacuuaacucauuuaaagaauacuuuaaucuuaggaauugcacuuuuauguacacauauaacaucacggaagaugaaauauuagaaugguucggaauuacacaaacagcccaaggcguucaucuuuucucuucucgcuauguagaucuauauggagguaacauguuucaauucgcuacuuugccaguauaugauacaaucaaauauuacucuaucauaccccacucaauucgcagcauucaaucugaucgaaaagccugggccgcauucuaugucuauaaauuacaaccauuaaccuuccuuuuagauuuuuccgucgacggcuacauaagacgcgcaauagacugcgguuucaaugauuuaagccaacuacauugcucuuaugaaucuuucgaugucgaauccggaguuuauaguguaucaucauuugaagcuaaaccaucugguucuguaguggaacaagccgaagguguugaaugugacuucuccccuuuacuuucaggaacaccaccacaaguauacaauuuuaaacgauuaguauucacaaauuguaacuacaauuuaaccaaauuauuaucguuauuuucugucaaugauuuuaccugcucacagauauccccggcugcaauagcaucuaauuguuacucuucauuaauucuugauuacuuuuccuauccacuaucgaugaaauccgacuuguccguaucgucugcagguccaauuucucaauucaacuauaaacaaucuuucucaaacccuaccugccuaauauuagcaacaguuccacauaauuuaacaacuauuacaaaacccuuaaaguauucauauauuaauaaauguagcagacuacuaucagaugauagaacagaagucccacaacucgucaacgcuaaccaguauucaccaugugucucuaucguuccaucaaccguuugggaagacggagacuauuauagaaaacaacuuucaccccucgagggaggaggauggcuaguagccucaggaucuacgguagcuaugacugaacagcuacaaaugggcuuuggcauaacuguacaauauggaaccgauacuaauucaguauguccuaaacucgaauuugcuaacgacacuaaaauagcuucacaauuaggaaacugcguagaauauucucucuauggagucucuggccgaggugucuuccaaaacugcacugcaguaggaguccgucaacaaagauuuguuuacgaugcuuaucaaaaucuaguaggcuauuauucagacgauggaaacuauuacugcuuacgcgccuguguaucagucccaguaucagucauauacgauaaagaaaccaaaacacacgcaacauuauuuggcucaguagcaugcgaacacaucucuucuacaauguuccaauacucaagauccacaagaucaauguuaaaaagaagggauucaacauauggcccucuccaaacacccguaggauguguccucggacuuguaaacuccucacuauuuguugaagauuguaaauuaccauuaggucaaucucuuugugcauuacccgauacaccuucuacacucacaccacguucaguucgcucaguaccuggcgaaaugcguuuagcaagcauagccuuuaaucauccaauccaaguagaucaacuuaacuccucuuacuuuaaacuauccaucccaaccaauuucagcuucgguguaacacaagaauauauucaaacaacaauucagaaaguaacaguugacugcaaacaauacgucuguaauggauuccaaaaaugugaacaauuauuaagagaauauggacaauuuuguucaaaaauaaaucaagccuuacacggagcaaacuuaagacaagaugauucuguccgcaaccuauuugcaucaguaaaauccucacagaguuccccaaucauacccggauuugguggagauuuuaauuuaacccuuuuagaacccguuucaauaucuaccggaucccguucagcacgcucagcuauagaagacuuauuauuugacaaaguaacaauagcugauccaggcuacaugcaagguuaugacgacuguaugcaacaaggaccagcaucagcuagagaccuaaucugugcacaauacguagcaggcuacaaaguacuacccccucucauggauguaaacauggaagcugcauauacaucaagucucuuaggcucuauagccgguguugguuggacagccggucuaagcucuuucgcagcuaucccauucgcacaaucaauauucuauagacuaaacggaguuggaauaacucaacaaguauuaagcgaaaaccaaaaguuaauugcaaacaaauucaaucaagcacuaggugcaaugcaaacgggguuuacaacuacaaaugaagcauuuagaaaaguucaggaugcaguaaacaacaacgcacaagcacucucuaaauuagcaucagagcuauccaacacuuuuggugccauauccgccuccauuggagacauuauacaaagacucgauguucuagaacaagacgcccagauugaccgacuaauuaauggaagacuaacaacuuuaaaugcauuuguugcacagcaauuaguaagaagugaaucagcggcccucucugcccaguuagcuaaagauaaagugaaugaaugcgugaaagcccagucuaaaagauccgguuuuuguggacagggcacacauauuguuuccuucguaguaaaugcaccaaauggacucuauuucaugcacguagguuauuauccuuccaaccacauugagguaguaucagcauacggcuuaugugacgcagcaaauccaacaaacuguaucgcaccaguaaacgguuacuuuaucaagaccaacaacacaagaauaguagacgaaugguccuacacuggcaguucuuuuuacaguccugagccuauuacaucuuuaaacaccaaauauguggcaccacaaguaacauaccaaaauauaucaacaaaccuuccacccccgcugcuuggcaacuccacaggaaucgauuuucaagacgaauuagacgaguucuucaaaaaugugucaaccucuauaccuaacuuuggaucucuuacacaaauaaauacaacacuucuugaccuaacauacgaaaugcucucacuccaacaaguaguuaaagcucuuaacgaaucauauauagaccuaaaggaacuuggaaauuacacauauuacaacaaauggccgugguacaucuggcuugguuuuauagcuggucuagucgccuuagcccucuguguuuucuuuauuuuauguuguacaggaugcggcaccaacugcaugggcaaauuaaaaugcaaccgaugcugugaccgauaugaagaauaugaccuggaaccacauaaagugcauguucacuga

SEQ ID NO: 1147 - RNA, 4062 nt, Artificial Sequence
  derived and/or modified CDS sequence (opt6) from MERS-CoV__ALL26396__S
augauccauucaguauuucuccuaauguuucuucuuacucccacagagucuuacguagacguugguccugauucaguaaaaagcgcauguauagaagucgacauccaacaaacauucuuugacaaaacauggccccguccaauugacguauccaaagccgacgguauaaucuauccucaaggcagaacauacagcaacauaacuaucacguaccaaggucuauucccauaccaaggagaccacggugacauguauguauauagcgcuggacaugccacgggaaccacuccucaaaaacuauuuguagcaaacuacucccaggacgucaaacaauuugcgaauggauuuguaguacguauaggugcagcagcaaauucaacaggcacuguaauaauauccccuucaacaagcgcuaccauacguaaaaucuacccugcauucaugcuuggaucaaguguaggaaacuuuagcgacggcaaaaugggaagauucuuuaaucacacacuuguacuauuaccagaugguugcggaaccuuacuucgcgcauuuuauuguauccuugaaccaagaagcggaaaucacugccccgcuggcaacucauauacuucuuuugcaacauaucacacgccagccaccgauugcucagaugguaacuauaacaggaacgcaagucucaauaguuucaaagaauacuuuaaccuaagaaauuguacguucauguacaccuacaauauaacagaagacgaaauauuagaaugguucggaauuacccaaacagcacaagguguacaucuguuuaguucucgauacguugauuuguauggaggcaacauguuccaauuugcuacuuuaccaguguaugacaccauuaaauauuauucuauuauaccucacaguauaagauccauacaaucagacagaaaagcaugggcugcauuuuacguuuacaaguuacagccacucaccuuucuauuggauuuuucgguagauggauacauucgucgagccauagauugcggauuuaaugacuuaucacaauuacauugcucauacgagagcuucgacguugaauccggaguauauagcguuaguaguuucgaagcaaaaccaucuggaucugucguagaacaagcagaaggagucgaaugcgauuuuucaccuuuauuaucugguacaccuccccaagucuacaauuucaaacgacuggucuucacaaauuguaacuauaauuuaacaaagcuacucucacuguucucuguuaaugauuuuacaugcucucaaauaucuccagcagccauagcaucaaauugcuacagcucacuaauccuagacuacuucucuuauccccuuucgaugaaaagcgaccucucaguaucguccgcaggcccuauaucacaauucaauuauaagcagucauuuucuaauccaacuugccuaauauuagcaacaguaccccauaaucuuacuacaauuacuaaaccacucaaauauucuuacaucaauaaauguucaagacuuuuaucagaugaucgaacugaaguaccacaauuagucaacgccaaccaauacucuccaugcguaucaauuguaccuucaacgguuugggaagauggagacuauuacagaaaacaacuaucacccuuggaaggcggaggaugguuaguugccucaggaucuacgguagcuaugacugaacaguuacaaaugggauuuggaauaacuguccaguacggcaccgauacgaauagcguauguccaaaacucgaauuugcaaaugauacaaaaaucgcaagucaauuagguaacuguguugaauauucacuauacggcguaagcggacgaggcguauuucaaaacuguacagcagugggaguucgucaacaacguuucguauacgaugcauaccaaaaccuagucgguuauuauagugacgacggaaacuauuacugucuacgcgccuguguuuccguuccagucucaguaauauaugauaaggaaacaaaaacucacgccacacuuuucgguucaguagcuugugaacacauaucaucuacaaugucucaauacucaagaucaacccgaaguaugcuuaaaagaagagacucuacauacggcccacuacaaacuccaguaggaugcguacugggucuuguaaauagcagccuaagcguagaagauuguaaauuaccauuaggucaaucucuaugugcacuccccgauacaccaucaacguuaacaccccgaucaguucgaagcgucccaggagaaaugagacuugccuccauagccuuuaaucaucccauacaagucgaucaacuuaauucuucauacuucaaacuuucuauucccacuaauuucucuuucgguguaacucaagaauacauccaaacaacuauacaaaaagucaccguggauuguaagcaauaugucuguaauggauuucaaaaaugugaacaauuacucagggaauacggccaauucugcucuaaaauaaaccaagcauuacacggagcaaauuuacgccaagacgauucuguacgaaaucuauuugcaucaguuaaaucaucacaaucaucacccauaauuccuggcuuuggaggugacuuuaacuuaacacucuuagagcccgucagcauaucaaccgguucccgaucugcacgauccgcaauagaagauuuauuauuugacaagguaacuauagccgauccaggauauaugcaaggauaugaugauuguaugcaacaaggaccagccuccgcccgugaccuaauaugcgcacaauaugucgcuggauauaagguccucccuccacuaauggauguaaauauggaagcagcauacacuucgucauuauuagguuccauagcugguguaggauggacagcaggauuaucaucauucgccgccauucccuucgcgcagagcauauuuuaccgguuaaacggcguaggcaucacacaacagguacuauccgaaaaucaaaaacuuauagcuaauaaauucaaucaagcauuaggggcaaugcaaacaggcuuuacaacaacuaaugaggcuuuuagaaaaguucaagacgcuguuaauaacaaugcacaagcacuauccaaguuagcaucugaauuauccaacacauucggagcaaucucugcaucaaucggagacaucauucaaagacucgauguucuagaacaagaugcucaaauugaucggcuaauuaauggaagauuaaccacccuaaaugccuucguagcucagcaauuaguacgcucagaaucugcagcauuauccgcucaacuagccaaagacaagguaaacgaaugcguaaaagcccaaucaaagagauccggguuuuguggacaagguacacauaucguaucuuuugucguaaaugcucccaauggacuuuacuuuaugcaugugggauacuauccgucaaaucacauugaaguaguuucggcauauggccuaugugacgcagcaaaucccacuaauuguauagcaccagucaauggcuauuucauaaaaaccaauaauacaagaauaguagaugaauggaguuauaccgguucaucuuucuaugcaccagaacccauaacaucgcuaaauacuaaauauguggcuccacaaguaacuuaucaaaauauaucaaccaauuuaccaccaccucuucuaucaaauucaacaggcauugauuuucaagaugaacuagaugaauuuuucaaaaacguuucuaccucaauaccaaacuuuggaucauuaacucaaauuaacacaacacucuuagacuuaacauaugaaauguuaucauuacaacaaguaguaaaagcucuuaaugaaucauauaucgacuuaaaagagcuaggcaauuacacauauuacaauaaauggccaugguauaucugguuaggguuuaucgcuggucuagucgcauuagcauuguguguuuucuuuauccuauguugcacugguugugggacaaauugcaugggcaaguugaaauguaauagaugcugugaucgauaugaagaauacgacuuagaaccucauaaaguucacguacacuaa

SEQ ID NO: 1148 - RNA, 4062 nt, Artificial Sequence
  derived and/or modified CDS sequence (opt6) from MERS-CoV__ALS20350__S
augauucauuccguauuccuucucauguuccuuuuaacaccaacagaaagcuauguugacgucgguccagauagcgcaaaaucagcuuguauugaagucgacauccaacaaacuuucuuugacaaaacauggccaagacccaucgacguuuccaaagcagacggaauaauuuauccacaaggcagaaccuacagcaauauuacaauaacauaucagggccuauuuccauaccaaggagaccacggcgauauguacguauauuccgcuggacaugcuacagggacaacuccccaaaaguuauuugucgccaacuacagucaagacguaaaacaauucgcaaacggauucguagucagaauuggagcagccgcaaacaguaccggaacaguuauaaucucuccaucaacauccgccacuauaagaaaaauuuaccccgcauucaugcuagggagcucuguagguaauuuuucagauggcaaaaugggaagauucuuuaaucauacccuaguccuuuugccggauggguguggcacacuauuacgagcauuuuauuguauacuagaaccgagaucaggcaacuauugcccagcaggaaacucauacacaucuuuugccacauaucauacuccagccacagauugcagcgacggaaauuauaauagaaaugcauccuuaaacucauuuaaagaguauuucaacuuacgaaacugcacauucauguacacuuacaacauuacagaagaugaaauacuugaaugguuuggaauaacucaaacagcacaagguguucauuuauuuuccucacgcuauguagaucucuauggaggcaacauguuucaauuugccacccuccccgucuaugauacaauaaaauauuauucuauaaucccacauucaauuagaucaauccaauccgauagaaaagcaugggcagcauuuuacguuuauaaauuacaaccacuuacauuuuuacucgauuuuucaguagacggauauauaagacgagcaauagacugcgguuuuaacgaucuuucucaacuucauuguaguuacgaaucauucgauguggaaaguggaguuuauucaguauccucuuuugaagcaaaaccuagcggcucuguaguagaacaagcagaaggaguagaaugugauuucucaccccuucuuucaggaacacccccgcaaguauauaauuucaaaagacuuguauuuaccaauuguaacuauaauuuaacaaaacuccuaucccuauuuuccguaaaugauuucacauguucucaaauaucacccgccgcuaucgcaaguaauugcuacucuucucuuauucuagauuauuucuccuaucccuuaucuaugaaaucagaccuuucaguaagcagugcaggacccauaucacaauuuaauuauaagcaauccuucucaaacccaacuugucuaauauuagcaaccguaccacacaacuugacaacaauuacaaaaccccuaaaauacaguuauauuaacaaauguagccgcuuacuaagugacgauagaacagaggucccacaauuagucaacgccaaucaauauucaccuuguguaaguauaguacccuccacagucugggaagauggugacuauuaucguaaacaacuaucacccuuagagggcggcgguuggcucguagcaaguggaaguacuguagcaaugacagaacaacuucaaaugggauucgguaucaccguucaauauggaacagacacaaauucaguaugcccaaaacuagaguucgccaaugacacaaaaauagcuucacaacugggcaauugcguugaauauucguuauaugguguauccggaagaggcguauuucaaaacugcacugcaguaggaguaaggcaacaaagauuuguauacgacgcauaccaaaaucuuguaggauauuauucagacgauggaaacuacuauugucucagagccugcguuaccguuccagucuccguaauauaugacaaagaaacaaaaacacaugcaacucuauucggcucuguagcuugcgaacacauuucaucaacaaugucacaauauucacgcucuacaagaaguaugcucaaacgaagagauaguacguacggaccucuccaaaccccaguaggcugcguacugggacuuguuaacucaucacuauucgucgaagauuguaaauuaccacuuggucaaucccuaugcgccuuaccugauacaccuuccacacuaacuccccgaucaguccguuccguuccaggcgaaaugagacucgcaaguauugccuucaaucaucccauacaaguugaucaacuaaacagcuccuacuuuaaacuaucaauaccaacaaacuuuuccuuuggcguaacacaagaauacauacaaacuacaauucaaaagguuaccguugauuguaaacaauaugucugcaacgguuuccaaaagugugaacaacuacuuagagaauauggucaguucuguucaaaaauaaaucaggcauuacacggagcaaaccuacgacaagacgauucaguaagaaaucuauucgcuucugugaaaagcuaucaaaguucaccuauuauacccgguuucggaggagauuuuaauuuaacucuauuagaaccagucucaaucucuacaggauccagaucugcacgaucagccauugaagaucuuuuauucgacaaaguaacaauagccgaucccggauauaugcaaggauacgaugacuguaugcaucaaggucccgcuagugcccgcgacuuaauaugugcacaguacguagcaggauauaaaguacucccaccccuuauggaugucaacauggaagcagcauauacgucaucucuccuaggaucaauagcaggaguaggcuggaccgcaggacuaucaucauuugcggcaauacccuuugcacaaaguauauucuaucgacucaauggcguaggaauaacccagcagguuuuaagcgaaaaccaaaaacuuauagcuaacaaauuuaaccaagcucuaggugcuaugcaaacugguuuuacaaccacaaaugaagcauuccaaaaaguacaagacgcagucaacaacaacgcacaagcacuuagcaaacuggccagugaacuauccaacacuuuuggugcuauaucagcaucaauaggagauauaauacaacgcuuagacguccuagaacaggaugcacaaauugacagacuaauuaauggacgccucaccaccuuaaaugcauuugucgcacaacaauuaguuagauccgaauccgccgcccuaagugcucaauuagcuaaggacaaaguaaaugaaugcgucaaagcucaauccaaacgcucugguuuuuguggucagggcacucacaucguaucauucguuguaaacgcacccaacggucuuuacuuuaugcaugugggauacuaucccucuaaucacauagaaguaguaagugccuacggacucugugaucucgcgaaccccacaaauuguauagcaccuguaaauggauacuuuaucaaaacuaacaacacaagaauaguugaugaauggucuuauacuggaucaucguuuuaugccccagaaccaaucacuucauucaauacuaaauauguugccccacaaguaacauaccaaaauauuagcacaaaccuacccccuccauuacucggcaacuccacgggaauagauuuccaagaugaacuagacgaguucuucaaaaauguaucuacauccauaccaaauuuuggaagccuaacucaaauaaacacuacauuacucgacuuaacauaugaaaugcuauccuuacaacaaguagugaaagcucuaaacgaaaguuauauugaucuuaaagaauugggcaauuacacauacuacaauaaguggccgugguauauaugguugggcuucauugcaggauugguagcccuagcucuuuguguauucuucauacuauguugcacaggcugugguacaaauugcauggguaaguuaaaauguaauagauguugcgacagauacgaagaauacgauuuagaaccacauaaaguacauguacacuaa

SEQ ID NO: 1149 - RNA, 4062 nt, Artificial Sequence
  derived and/or modified CDS sequence (opt6) from MERS-CoV__ALT66880__S
augauacauucuguauuucuacuuauguuucuuuuaaccccaaccgaaucauauguagacguaggucccgauucugucaaaucugccuguauagaaguagacauacaacagacuuucuucgauaagaccuggccccgucccauagacguaucaaaggcagaugguauaaucuauccacaaggccguacuuauaguaauauaacgauuacuuaccaaggucuauuccccuaucaaggagaucauggugacauguacguauauagugccggucaugcgacaggcaccacaccacaaaaauuauuuguagcgaacuacagccaagauguaaaacaauuugccaaugguuuugucguaaggaucggagcagcagcuaacucaacaggaacaguaauaauuucaccaucaacuucugcaacuauaagaaaaauuuaucccgcguuuauguuaggaucuaguguaggcaauuuuucagauggaaaaaugggucgauuuuucaaccauacacuuguacuacuuccugauggaugcggaacucuccuccgcgcuuucuacugcauuuuagaaccaaggagcggaaaucauugcccggcuggcaacucauacacauccuuugcaacauaucauacuccugccacugauugcuccgacggaaacuauaaucgcaaugcaucauuaaacaguuuuaaagaauacuuuaauuuaagaaauuguacguucauguacacuuauaauauuacugaagaugaaauacuagaaugguuuggaauuacacaaacggcacaagggguacaccuauuuucaucuagauauguagaucuauacggcggcaacauguuccaauucgcuacccuacccguauacgacacaauaaaauauuauaguauaaucccacacuccauaagauccauccaaucagacaggaaagcaugggcagcauuuuauguuuacaaauuacaaccacuuacauuccucuuggauuuuucaguugaugguuauauccgacgagcaauagauuguggauucaaugaccuuucccaacuccacugcucuuaugaaucguucgauguugaaucaggcgucuauucgguuuccucauuugaagcuaaacccuccgguaguguuguagaacaagcagaaggaguggaaugcgacuucucuccccuccuaagcgguaccccaccgcagguuuacaacuucaagcgauugguuuucacaaauuguaauuacaaucucacaaaacuucucucacuauuuuccgucaacgacuuuacauguucucagauuagcccugcagcuauagcaaguaacugcuacucaucauuaauauuagauuacuuuagcuacccccuuucgaugaaaucugacuuaucagucucuuccgcuggaccaauaucacaguucaauuauaagcaaucauuuucaaaucccacauguuuaaucuuagccacgguaccccauaacuuaacaacaaucacaaaaccucuaaaauacagcuauauaaauaaaugcagucgucuacuuagugaugauagaacugaaguaccacaauuaguaaaugcaaaccaguacagucccuguguaucaaucguuccaucuacaguaugggaagauggcgacuauuaccgaaaacaacucucacccuuagagggaggaggcugguuaguugcuagcggaucuaccguagcuaugacagaacaauuacaaaugggauuuggaauuaccguacaauacgguaccgacacuaacucaguuugcccaaaacuagaauuugcaaaugauacuaaaaucgcaucacaacucggaaauugcguugaauacucauuauacggagucucagguaggggaguauuccaaaacuguacggcaguaggaguucgccaacaacgauuuguuuaugacgcauaucaaaacuugguaggauauuauagcgacgacgguaauuacuacugccuccgagcaugcgucucggucccaguaucuguuaucuacgauaaagaaacaaaaacacaugcuacacuauucggcucugucgccugcgaacacaucucuucuacuaugagucaauacucaagaucaacacguucaauguuaaaaagacgagacucaacauauggcccuuuacaaacgccuguuggauguguccuaggucuaguuaauucaagucuauuuguagaagauugcaagcuaccacucggacaaucauuaugugcacugcccgacacuccaucuacccuuacaccccgaucaguucguagcguaccaggagaaaugagauuagccucaaucgcuuuuaaccaccccauacaagucgaucaacucaacucaucuuauuuuaaauuaucaaucccuacaaacuuuucauucggagucacgcaagaauauauacaaacuacaauccaaaaaguuacaguugauugcaaacaauauguaugcaacggcuuucaaaaaugugaacaauuacuuagagaauauggccaauucugcaguaaaaucaaucaagcacuacacggagcaaaucuucgucaagacgauucuguaagaaaucuauuugcaucaguaaaauccucacaaucuucaccaauaauaccuggcuucggaggugacuucaaucuaaccuuauuagaaccaguuucaauuucuaccgguucaagaucagcgaggagugccauagaagauuuauuauucgauaaaguaaccauugccgauccugguuauaugcaagguuacgaugauuguaugcaacaaggucccgcuuccgccagagacuuaauuugcgcacaauaugucgcaggauauaaagucuuaccuccgcuaauggauguuaauauggaggcggcauacacaagcucgcucuugggaucaauugccgguguaggcuggaccgcaggccuaagcucauuugccgcuaucccauuugcccaaaguauauucuacagauuaaauggagucggaauaacucaacaaguacuuagcgaaaaccaaaaacucauagcaaauaaguuuaaccaggcucuuggagcgaugcaaacuggauucacaacaacgaaugaggcuuuuagaaaaguccaagacgccguuaauaauaaugcccaagcacuuucuaaauuagcaucagaauuaaguaauacauucggagcaauaucagcauccauaggcgauauaauucaaagauuagacguauuagaacaagaugcgcaaauugauagauuaauuaauggaagguuaacuacauuaaaugcauucguugcacaacaacuuguuagaagcgaaucggcagcccuaagcgcccaacuagccaaagauaaaguaaaugaaugcguaaaagcucaaucuaaaaggagugguuucuguggccaaggaacacauauaguauccuucguaguuaaugcaccaaauggacuauacuucaugcauguaggcuacuacccuucuaaccauauagaaguaguuuccgccuacggguuaugugacgcagcaaaccccacaaacuguauugcacccguaaauggauacuuuauaaaaacaaauaauacacgaauagucgaugaaugguccuacacaggguccucauucuacuccccagaaccuauaacaagucucaauacuaaauacgucgcaccacaagucacauaccaaaauauaucaacuaaucucccacccccuuuacuugguaacuccacagggauagauuuccaagaugaauuagacgaguucuuuaaaaauguauccacaagcaucccaaauuucgguagccuaacucaaauuaacacuaccuuacuugaucuuaccuacgaaaugcuuagucuucagcaaguuguaaaagcccucaaugaaucauacauugaucuuaaagaacugggaaauuacacuuauuacaacaaauggccuugguauaucugguugggcuucauagcaggacuuguagcacuagcucugugcguauuuuucauauuaugcugcaccgguugcggaacaaacugcaugggcaaacucaaauguaaucgcugcugugacagguaugaagaauacgaucuagaaccccauaaaguucacguccacuaa

SEQ ID NO: 1150 - RNA, 4062 nt, Artificial Sequence
  derived and/or modified CDS sequence (opt6) from MERS-CoV__ALA49341__S
augauccauucaguuuuucuccuuauguuuuuacuuacacccaccgaaucauacguugacguaggaccagauucaguaaaaucagccuguauagaaguagacauucaacaaacauuuuucgauaaaacuuggccaagacccauagauguguccaaggcugauggaauuauauacccccaaggucgaacauauuccaauauaacaauaacauaccaaggacucuucccuuaccaaggugaucauggagacauguauguauacucggcaggccacgcgacuggcacuaccuuacaaaaauuauucguugcuaauuauucucaagauguuaaacaauuugcuaauggauuuguuguucgcauuggagccgcugcaaauucaaccggaacuguaauuauuucuccuaguacaucugcuaccauacgaaaaaucuacccugcauuuaugcuagguaguuccguuggaaacuuuuccgauggcaaaaugggaagauucuuuaaucauacucuuguucuccuacccgaugguugcggaacauuauuacgagcuuuuuacugcauauuagaaccuagaucuggaaaucauuguccugcaggaaacuccuauacauccuuugcaacuuaccacaccccagccacugacugcucugaugguaauuacaaccgaaaugcuucauuaaacaguuucaaagaauacuuuaaccugagaaauugcacuuuuauguauacauauaauauaacugaagaugaaauauuggaaugguuugguauaacccaaacagcacaaggaguccauuuauuuuccuccagauaugucgaucuauacggaggcaauauguuccaauucgcaacucuuccaguauaugauacgauaaaauacuacucuaucaucccucauuccauacgcucaauucaaagugaucguaaagccugggcggcauuuuacgucuauaaacuacaaccucuuacuuuucuacucgacuucuccguagauggcuauauccgacgagcaauagauugcggauucaaugacuuaucacaauuacacugcucauaugaaucauucgacguagaaucagggguauacucuguaucaucguuugaagcaaaaccguccggauccgucgucgaacaagcagaaggaguugaaugcgacuucucuccacuguuaucugggacaccaccccaagucuauaauuuuaaacgacuugucuuuaccaauugcaauuacaaccuuacuaaacuacuaucucuguuuaguguaaacgauuuuaucuguucacagauaucuccugcugcaaucgcuucaaauugcuauaguucacuuauauuagauuacuuuucauauccacuuuccaugaaaagcgacuuaucaguuucauccgcuggcccaauaucccaauucaacuacaaacaaucauucucaaauccaacaugcuuaauucuagcaacagucccucauaaccuaacaacuauuacuaaaccacuaaaauacucuuauauuaacaaguguuccagacuuuuaucagaugaucguacagaaguaccccaacucguaaacgcuaaucaauacucuccaugcguuucuauaguccccucuacaguaugggaagacggcgauuauuaucgcaaacaacuaagcccucuugagggaggcggaugguuagucgcaagcgguucaacaguagcgaugacagaacaacuccaaaugggauuuggaauaaccguacaauauggaacagauacaaauucuguuuguccuaaacuagaauuugcaaaugacacaaaaauagcaucccaacucggaaacugcgucgaauauucacuuuacgguguaucuggacgcggaguauuucaaaacuguaccgcaguuggcguucgacagcaaagguucguauaugaugcuuaccaaaaucugguaggauacuauucagacgauggaaacuauuacuguuuacgagcauguguauccguaccaguaucagucaucuaugauaaagaaaccaaaacacacgcuacacuauuuggaaguguagcaugcgaacacaucucaucuacaaugucgcaguacucacgauccacaagaucaaugcucaaacguagagauucuaccuauggaccucuacaaacccccgucggauguguuuuaggucuuguuaauuccucacuauuuguagaagauuguaaacuaccauugggucaaucccuaugugcacuaccagauacaccgucuaccuuaaccccuagaucaguaagauccguaccuggcgaaaugcgacuugcauccauagccuucaaccauccaauucaaguggaccaauugaacucuaguuacuuuaaacuuuccauccccaccaacuucuccuucggcguaacucaagaguauauacaaacuaccauccaaaaaguuacaguagacuguaaacaauacgucugcaauggcuuucaaaagugugaacaacuauuaagggaauauggucaguucuguucaaagauuaaucaagcauuacauggugcaaaucuuagacaagaugauucuguaagaaauuuauuugcaucugucaaaucaucacaaucaucucccaucaucccaggauuuggaggagauuuuaaccuuacuuuacuugaacccgucucaauaagcaccggcucccggagugcucgaagugcgauagaagaucuuuuauuugauaaaguaacaaucgccgauccaggguacaugcaaggauaugacgacuguaugcaacaagguccugcauccgcacgcgaucuaauaugugcucaauacguagcaggauauaaaguucuacccccucuaauggaugucaauauggaagcagcauauaccuccucccuuuuaggaucaauagcgggcgucgguuggaccgcuggauuaagcagcuuugcagcaauaccauuugcccaaucuaucuucuauagacucaauggagugggaauaacacaacagguuuuaucugaaaaucaaaaauuaauagcuaauaaauucaaccaagcauuaggugccaugcaaacaggauuuacaacuaccaaugaagcauuuagaaagguacaagacgccguaaauaauaacgcgcaagcauugucuaaauuagccucagaacuauccaacacuuucggugcuauauccgccuccaucggagacaucauacaacgauuagacgucuuagaacaagacgcacaaaucgauagacugauuaaugguagguuaacaacccucaacgcuuucguugcucaacaacuuguacguucagaauccgccgcauuauccgcucaacuagcaaaagacaaagucaacgaaugugucaaagcccaaucaaaaagaucaggauuuugcggucaaggaacacauaucguaucauuuguuguaaaugcucccaacggucuuuacuuuaugcauguuggcuauuacccuucuaaccauauagagguaguuucagccuacggucucugcgacgcugcaaacccuacuaauugcauugcuccugugaacggauauuuuauaaaaacaaacaauacuagaauaguagacgaauggaguuacaccggaucuucguuuuacgcuccagaacccauuacuucacucaauacaaaauacguagcaccacaggucacuuaccaaaauauaagcacuaaucuuccaccaccacuccugggcaauucuacggggauagacuuucaagacgaauuagaugaauuuuucaaaaaugugucaacuucgauucccaauuucggcucccucacccagauaaacacaacucuuuuagauuugacauaugaaaugcucucucuucaacaaguuguaaaagcacuuaaugaguccuacaucgaucuaaaagagcuaggaaacuacacauauuauaauaaguggccgugguauauauggcugggauuuauugcaggacucguugcacuagcacuaugcguauucuuuauuuuauguuguacaggaugcgguacaaacugcaugggaaaacuuaaauguaacagaugcugugaccguuacgaagaauaugaucuugagccccauaaaguacacgugcauuaa

SEQ ID NO: 1151 - RNA, 4062 nt, Artificial Sequence
  derived and/or modified CDS sequence (opt6) from MERS-CoV__ALA49352__S
augauucauuccguauuucuccucauguuuuuauuaacucccacagaaaguuauguagacguaggucccgacucaguaaaaucagcuugcaucgaaguagacauacaacaaacuuucuucgacaaaacuuggccccgaccuauagacgucuccaaagcagacggcauaauauauccccaaggacgaacauacucuaacauuaccaucacauaccaaggcuuauuuccauaucagggcgaccacggagauauguacguuuacucugcgggacaugcuacugguacuacaccccagaaacuguuuguugcaaacuauucgcaagacgucaaacaauuugcaaaugguuuugucguaaggaucggugcugccgcaaacucuacaggaacgguaauaaucucaccaaguacaucagcaacuauucgaaaaaucuacccagcauuuaugcuaggaucgucaguaggaaauuuuuccgacggaaaaaugggccgauuuuucaaccacacuuuaguacuacuaccugauggcugcggcacacuccucagagcauucuauuguauucucgaaccucguucaggcaaccacuguccugccggaaauaguuacacaucguucgcuacguauuacacuccugccacagauuguucagacgguaauuauaaccgaaaugcuagccucaauuccuucaaagaauauuucaacuuaagaaauuguacguuuauguacaccuacaauauuacagaagacgaaauuuuagaaugguuuggcauaacacaaacagcacaaggcguacaccuuuuuagcucacgcuacguagaucuauacggcggcaacauguuucaauucgcaacucuuccuguuuaugauacaauuaaauauuauuccauaauaccucauuccauacgaucgauccaauccgauagaaaggcuugggcagcauuuuacgucuauaaacugcaaccacuaacauucuuauuagacuucucaguagauggauauauacgccgagcaauagauugcgguuucaaugaucuaucccaacuacacugcucauacgaaucauucgacguagaauccgguguauacagugucagcucauuugaggcaaaacccaguggaucgguagucgaacaagcggagggagucgaaugcgacuuuucaccauuacuuucuggaacaccaccacaaguauauaauuucaaaagauuaguauucacaaauugcaauuauaaucuaaccaaacuucuaucauuauuuuccgucaacgauuucacaugcucccaaaucuccccagcugcaaucgcaaguaacuguuauucaagucuaauacuagauuacuuuaguuacccuuuaucaaugaaaucggacuuaucaguaucuucagccgggccaauaucccaguucaauuauaaacaaucauucucaaauccaacuuguuuaauucuagcuacgguuccccauaaucucacaaccauaacaaaaccacucaaauacucuuauauaaauaaaugcucacggcucuuauccgacgauagaacagaaguaccucaacucguaaaugcuaaccaguacucuccauguguaucuauaguacccucaacuguaugggaggacggugauuacuacagaaaacaacuuuccccacucgaagguggcggauggcucguagccagcggaucuacuguagccaugacagagcaauuacaaaugggcuuuggaauaaccguucaauauggcacagauacaaauucaguauguccuaaauuagaguucgcaaacgauacaaaaauugccucccaguuggguaacugcguagaauacucuuuguacggaguaucaggacguggcguuuuucaaaacuguaccgccguaggcguacgacaacagcgauucguuuacgaugcauaucaaaaccuaguagguuacuauucagaugauggaaauuacuauuguuuaagagcuuguguaucugucccagucucuguuaucuacgacaaagaaacuaaaacacacgcuacacucuuugguucaguugccugcgaacauauaaguuccaccaugucgcaauauucuagauccaccagaucuaugcuaaaaaggcgugacucuacuuacggaccauuacaaaccccaguuggcuguguuuuaggacugguaaauuccucacucuuugucgaagauuguaagcuaccgcucggacaaucacuaugugccuuaccagauaccccaagcacguuaacaccuagaucaguaagaucagugccaggugaaaugagacuugcaucaauugcauucaaccaccccauacagguagaucaacuaaauucuagcuauuuuaaacucucaauccccacaaauuuuuccuucggaguaacacaagaauacauacaaacaacaauucaaaaaguaacaguggacugcaaacaauaugucuguaacggcuuccagaaaugcgaacaacuccucagagaauacggccaauuuugcucaaaaauaaaccaagcacuccacggugcaaauuuaagacaagaugacucaguaagaaaucuauucgcaucuguaaaaagcucucaauccucuccuauaauaccugguuucggcggagacuucaaucuuacccuccuagaaccagucucaauuaguacaggcagccgauccgcacguucugcuauugaagaucuccuuuucgacaaaguaaccauagccgauccagguuauaugcaagguuaugacgacugcaugcaacaaggaccugcuucugcacgcgaccuaauaugcgcucaauaugucgcaggauacaaaguccugccaccacuaauggauguuaacauggaagccgcauauacaaguucacuucucgguucaauagcuggaguaggcuggacagccggacuuucaucauuugcagccauuccuuuugcacaaucuauauuuuacagauuaaaugguguaggaauaacacaacaaguccuaagcgagaaucaaaaauuaauagcaaacaaauucaaucaggcuuuaggugcaaugcaaacgggcuuuaccacaaccaacgaggcuuucagaaaaguacaagacgcagucaauaacaacgcacaagcccuaucaaaacuugcgucagaauuaagcaauacuuuuggugcuauaucugcaucuauuggcgauauaauacaacguuuagacguacuugaacaagacgcacaaauagaucgucuuaucaacggcagauuaacaacauuaaacgccuuuguagcucaacaauuaguccgaucagaaagcgcugcccucucugcacaacucgcaaaagauaaagucaacgaauguguaaaagcucaaucuaaaagaucugguuuuuguggacagggcacucacauaguuucauuuguuguaaacgcaccaaauggccuuuauuucaugcacguaggauauuacccaucaaaccacauagaaguaguuagugcguacggccucugugacgcugcaaauccaacaaauuguauugcucccgugaacgguuacuuuauuaaaaccaauaacacucguauuguugaugaauggucauauacaggaucauccuucuaugcgccagaaccaauuaccucgcucaauacuaaauacguugcaccccaagucaccuaccaaaauauaucuacuaacuuaccacccccauuacuaggcaacucaacgggcaucgauuuccaagacgaacucgaugaguucuucaaaaauguuuccacuucaauucccaacuucgguucucuaacacaaaucaauaccacccuacuagacuuaacuuaugaaaugcuuagccugcaacaaguaguuaaagcacuaaacgaauccuauaucgauuuaaaagaacuugguaacuacacauauuauaacaaguggccaugguauauauggcuaggauuuaucgccggauuagucgcuuuagcccuaugcguauucuuuaucuuauguuguaccggauguggaacgaauuguaugggaaaacuaaaaugcaaucgcuguugcgaucguuaugaagaauacgaucuugaaccacacaaaguacauguucacuaa

SEQ ID NO: 1152 - RNA, 4062 nt, Artificial Sequence
  derived and/or modified CDS sequence (opt6) from MERS-CoV__ALA49363__S
augauacauuccguguuucuauuaauguuucuccuuacaccaacagaaucguacguugaugucgggccagacaguguaaaaucggccuguauugaaguugauauucaacaaacuuucuuugacaaaaccuggccccgaccuauagauguaagcaaagcagacgguauaauauauccucaaggucgaaccuauuccaauauaaccauaacguaucagggacucuuuccuuaucaaggagaucacggugauauguauguuuauucagccggacacgcaacagguaccacuccacaaaaauuauuuguugcuaauuacagucaggacguaaagcaauuugcgaacggcuuuguuguuagaauuggagcugcagcaaacucaacaggcacaguaauaauaucucccucgaccucugcaaccauaagaaaaaucuauccggcauuuaugcucggcucaucagucggaaauuuuucugacgguaagaugggaagauucuuuaaccauacacuuguacuacuaccagaugguugugguacauuauugagagcauucuauugcauccuugaacccagauccgguaaccacugcccagccggaaacuccuacacaucauuugcuacauaucauaccccugcaacagauuguuccgaugguaauuauaacagaaaugcuucucuuaacucauuuaaagaguauuuuaaucuccgaaacugcaccuucauguacacauauaauauaacagaagacgaaauucucgaaugguuuggaaucacacaaacagcgcaaggcguacaccucuuuucaucaagauaugucgacuuauauggagggaauauguuucaauuugcaacuuuuccaguauaugacaccauuaaauauuauucaauaauaccucacuccauucgcagcauucaaagcgauagaaaagcaugggccgcauucuauguauauaaauuacaaccacuaacauuucuucuugauuucuccguagauggguauauucguagagcaauagauuguggauuuaacgacuuaucccaacuucauuguagcuaugaaucauuugacguagaaaguggcguuuauaguguaucauccuuugaagcgaaaccaagcgguaguguuguugaacaagcagaaggaguugagugcgauuuuucaccacuuuuaucagguacacccccacaagucuacaauuucaaaagguuagucuuuacuaacuguaauuauaauuuaacuaaauuacuuucacuuuuuaguguuaacgauuuuacgugcucacaaauuucuccagcagcuauugcaucaaauugcuacagcucacuaauccuugauuacuuuagcuauccuuuauccaugaaaucugaccucagcguuuccucggcugggccuauaagucaauucaacuauaaacaaucauucaguaaucccacaugucuaaucuuagcaacagucccucauaaucuuacaacaauaacaaaaccccucaaauacucauacauuaauaaauguucucgucuucuaucagaugaucgaacagaaguaccucagcuaguuaacgcaaaucaauacucaccaugcguaucaauaguccccucuacggucugggaggacggugacuauuauagaaaacaauuaucaccauuagaaggagguggauggcuaguagcaucuggaucuacuguagcaaugacagaacaauuacaaaugggcuucggaauaacaguacaauacggaacugacacuaauaguguuugcccaaaauuagaauuugcaaacgacacaaagaucgcgagucaauuagguaauuguguagaauacucccuguauggagucucaggacguggaguauuucaaaauugcacagcaguaggaguuagacaacaacgguucguauacgaugcauaccaaaaucuaguaggauacuauucugaugaugguaacuauuauugccuucgugcaugcgucucuguaccaguaucaguaauuuacgauaaagaaacaaaaacacaugcaacauuauucggaucuguagcaugugaacauaucagcaguacaaugagccaauauucucgcucuacccgauccaugcuaaaacgaagagauuccacuuauggcccucuacaaacacccguaggauguguccuaggucuaguuaacucuucacuauuuguagaggauuguaaacuaccccucggacaaagccuaugugccuugcccgacacaccuuccacacuaacccccagaucuguaagaagcguaccaggagaaaugagauuagcuucaauagcauuuaaccauccaauacaaguugaucaauuaaauucuucuuauuuuaaauuaucuauaccuacaaauuuuucauuuggcguuacacaagaauauauucaaaccacuauacaaaaaguaacuguagacuguaaacaguacguaugcaacgguuuccagaaaugugaacaacuucuccgagaauacggccaguuuuguuccaaaauaaaccaggccuugcacggugcuaaccugagacaagaugacuccguccguaaccuauucgcaaguguaaaaucuucacaauccucacccaucauaccagguuuuggaggugacuucaaccuaacccuuuuagaaccagucucaauaucuacaggcagccguuccgcuagaagugcaauugaagaucuacuuuuugacaaaguaaccauagcagauccaggauauaugcaaggcuaugaugauuguaugcaacaaggacccgccucagcuagagaucucauuugcgcacaauaugucgcagguuacaaaguacuaccuccuuuaauggaugucaacauggaagcggcuuacacaucaucuuuacuaggaucgauagcggguguggguuggacagcaggauuaucuaguuuugccgccauuccuuuugcacaaucgauauuuuauagacuuaauggaguuggaauuacacaacagguauuaucagaaaaucaaaaacuaauugcuaacaaauuuaaucaagccuuaggcgcuaugcaaacugguuucacuacaacaaacgaagcauuccgaaagguccaagacgcgguaaauaauaacgcccaagcacucaguaaguuagccucagagcuuaguaauacauuuggcgcaauuuccgcuucaaucggagacauaauccagagauuagauguauuagaacaagacgcucaaauugauagauuaauuaauggucgacucacaacccucaacgcauucguagcucaacaacucguucguucagaauccgcagcauuauccgcccaauuagcuaaagacaaaguaaacgaauguguaaaagcacaaucaaaaagaucaggauucugcggacaaggaacacacauaguaucauuuguaguaaacgccccaaacgggcucuacuucaugcacguagguuacuauccauccaaccauauagaagucguaucagcauauggguuaugcgaugccgccaacccuaccaauuguauagcaccuguaaacggauacuuuauaaaaaccaacaauacacgcauaguagaugaauggaguuacaccggaagcuccuuuuaugcaccagaaccuauaacaaguuugaauacaaaguacgucgcuccacaagucacauaccaaaauauaucaacgaaucuuccaccuccuuuacuuggaaacucaacuggaauugauuuccaagaugaauuagaugaauuuuucaaaaacguaucaaccucuauaccuaacuucggaucauuaacccaaauaaauacuacccuauuagacuuaacauaugaaauguuaagccuacaacaaguaguuaaagccuuaaacgaauccuauauagaucuaaaagaacuuggaaauuauacauacuauaauaaauggcccugguacauuuggcuaggauucauagcaggucugguggcccuugccuuaugcguguuuuucauauuauguugcacggguuguggaacaaauugcauggguaaacuaaaauguaaucgcugcugcgaucguuacgaagaauaugaucuugaaccgcauaaaguucauguucacuag

SEQ ID NO: 1153 - RNA, 4062 nt, Artificial Sequence
  derived and/or modified CDS sequence (opt6) from MERS-CoV__ALA49374__S
augauacacucugucuuccucuuaauguuucuacucaccccuacagaaaguuacguagacguggggccugacucaguuaaaucagcuuguauagaaguugauauccaacaaacauucuuugacaaaacuuggccucgaccaauugaugucagcaaagccgacggaauaaucuacccucaaggaagaaccuauucgaauauuacuauaacauaccaaggucuuuuuccauaccaaggagaucauggcgauauguacguauacucagcaggacaugcaacugguacaacuccacaaaaacucuuuguugccaauuauagucaagauguuaaacaauucgccaacgguuucguaguccgcauuggagcugcggcaaacucuacagguacaguaauaauuucaccaucuacuucugcaacaaucaggaaaauauauccagccuucauguuagguucuucaguaggaaauuuuagcgauggaaaaaugggccgguuuuucaaucauacccuuguacuuuuaccagauggaugcggaacguuacuaagagcauuuuauuguauccucgaaccuagaucuggaaaccauuguccugcugguaauucuuauacaucuuuugcuacauaucacacucccgcaacugacugcuccgacggaaacuacaacaggaaugcaucauuaaacuccuuuaaagaauauuucaacuuacgaaacugcacauuuauguauaccuauaauaucaccgaagaugaaaucuuagaaugguucggaaucacacaaacagcacaaggaguccacuuauuuagcucuagauauguugacuuauacggaggcaauauguuucaauuugccacuuuaccaguuuaugacacuauaaaauauuauucaaucaucccacauucuauucgaucaauacagucagauagaaaagcaugggccgcuuuuuauguuuacaaacuccaaccacucacauucuuauuagauuuuuccguagauggauauauucgacgagcgauagauuguggauuuaaugacuuaucccaacuacauugcucauacgaauccuucgauguagaaucagguguuuauucuguguccucuuuugaagcaaaaccuaguggaucaguuguagaacaagcagaagguguugaaugcgauuuuucgccacuauuaucaggcacaccgccucaaguuuacaacuucaaaagauuaguauuuacuaauugcaacuacaacuuuacaaaacuucucagucuauucagcguaaacgacuucacauguucacaaaucucgccagcagcaauugcaaguaauuguuauuccucacucauacuggauuauuuuagcuacccacuuucaaugaaaagcgaccuaagcguaaguucagccggaccaaucucgcaguuuaacuauaaacaaaguuuuucuaauccuacaugcuuaauacucgcaacaguuccacacaaucuuacaacaauaacaaaaccucuaaaauauaguuauauuaacaaaugcucgcgauugcucagcgacgaucgaacagaagugccccaacuuguaaaugcaaaccaauauaguccaugugucucaauaguaccuucaacaguaugggaagacggcgacuacuacagaaaacaacuuagcccccuagaagggggagggugguuagucgcuucgggaucuacuguugcaaugaccgaacaacuacaaaugggcuucggcauuacgguccaauacggaacugacaccaauuccguuuguccuaaauuagaauuugcaaacgauaccaaaauugccucacaauuaggaaauugugucgaauacaguuuauauggugucuccggcagaggaguauuccaaaauuguacagcggucggaguaagacagcaacgcuuuguuuacgaugcauaccaaaaccuaguuggauauuauagugaugacggaaacuacuacugucuuagagcauguguuagcgucccuguaagcguaauauacgauaaggaaacaaaaacacaugcuacauuauucgggagugucgcgugcgaacauauaucuucgacuaugagucaauauaguagaucuacaagaucgaugcuaaaaagaagagauaguacauacggcccccuacaaacaccuguuggauguguauuaggacucguaaacucuucacuauucguagaagauuguaaacuaccacuugggcaaucauugugugcauuaccugauacuccuucgacgcucacgccucguucaguuagaucaguaccaggcgaaaugaggcuagcaucaauagccuucaaucauccgauccaaguugaccaacuaaauucauccuauuuuaaacuuuccauuccaacuaacuuuucauuugguguaacucaggaauauauccaaacuacuauacaaaaagucacuguggauuguaaacaauauguaugcaacggauuccaaaaaugugaacaacuguuaagagaauacggacaguuuugcucaaagaucaaucaagcacuacauggcgcaaaucuucgccaagacgauucagugagaaauuuauucgcaucaguaaaaucaucucaaucuuccccaauuauacccgguuuuggaggcgauuuuaaucuuacacucuuagaaccgguuucaauuucaacuggaucuagaucugcaagaucugcaauagaagaucuuuuauuugacaagguaacaauagcagauccuggauacaugcaagguuaugacgauuguaugcaacagggaccggcaagugcacgugaccuuauuugcgcucaauauguggcagguuauaaaguacugccaccccuaauggauguaaauauggaagcagcguacacauccagcuugcuuggguccauagcgggcgucgguuggacugcuggauuaucaucuuucgcagcuaucccuuuugcccaaaguauauucuauaggcuaaauggaguuggaauaacacagcaaguauuaucagaaaaucaaaaauuaauagcuaauaaguucaaccaagcacuaggagccaugcaaacagguuucaccacgacaaaugaggcuuuucguaaaguacaagaugcagucaacaauaaugcacaagcgcuuucaaagcucgcuagugaauuaucaaauacauuuggagcaauuucugcuucaaucggugacauuauucaaagacuugacguuuuagaacaagaugcacaaauagauagacuaauaaauggacgacugacuacuuuaaaugcauuuguugcccaacaauuaguuagaucggaaucagcagcuuuaucugcucaacuagccaaagauaagguuaaugaaugcgucaaagcacaaucuaaaagaucuggauuuuguggucaaggcacacauauaguuuccuuuguaguaaacgcaccaaaugguuuauauuuuaugcacguaggguauuauccaucuaaucacauugaaguuguuagcgcuuauggucuaugugacgcugcaaacccuacuaauuguauugcccccgucaauggauauuucaucaaaacaaauaacacgagaauaguagaugaaugguccuacacaggauccucuuucuaugcaccagaacccauaacuucauuaaacacaaaauauguugcaccucaagucacauaccaaaauauaagcaccaaccuaccuccaccguuauuaucuaacuccacuggaauagauuuccaagaugaacucgacgaguucuuuaaaaacguaucuacaucaauaccaaauuuuggguccuuaacacaaaucaacaccacacuacuagaucuuacauacgaaaugcucucacuacaacaaguaguuaaggcuuuaaaugaauccuacauagaccuuaaagaacuaggcaacuacacauauuauaauaaauggccaugguacauauggcugggcuucauagcaggcuuaguggcauuagccuuaugcgucuucuuuauacuuugcuguacaggaugcgguacaaauugcaugggaaaacuuaaaugcaauagauguugcgaccgauaugaagaauaugaucuugaaccccauaaaguacacguucacuga

SEQ ID NO: 1154 - RNA, 4062 nt, Artificial Sequence
  derived and/or modified CDS sequence (opt6) from MERS-CoV__ALA49396__S
augauccauuccgucuuucucuuaauguuucucuuaacccccacagaaucuuauguagacguaggacccgacuccgucaaauccgcaugcauugaaguagacauacaacaaacuuucuuugacaaaaccuggccucgaccgauagacguaucaaaagcugauggcauaauuuauccucaggguaggacauauucaaauaucaccauaaccuaucagggauuauuuccauaccaaggagaccauggagacauguacguauauagugcagggcacgccacagguaccaccccacaaaaauuauuuguagccaauuacucacaagauguaaaacaauuugcaaauggcuuuguugucagaauuggugccgcagccaacucuacaggaacugucaucauaagcccuucuacuucugcaacaauuagaaaaauauauccugcuuuuauguuagguucuuccguaggcaacuucucagaugguaaaaugggacguuucuuuaaucauacgcuugucuuauuaccugauggaugcggaacacuacuccgggcuuucuauugcauccuagaaccaagaagcggaaaucacuguccagcugguaauucuuauacuucauuugccacuuaucacacuccagcaacugauuguucagacggcaauuauaaucgaaaugccucacuuaauagcuucaaagaauacuucaaucuccgaaacugcacauuuauguacacauauaauauaacugaagacgaaauucuagaaugguucggaauaacgcaaacagcacaaggcguucauuuauucucaucucguuacguggaccuuuauggagguaacauguuucaauuugccacacuccccguuuacgacaccauaaaauauuauagcauaauaccucacucuauucgaucaauacaaucagaucguaaagcgugggccgcauucuaugucuauaaacuccaaccccuaacuuuucugcuagauuuuucaguagacgguuacauccgcagagcuaucgauugcggauucaacgaccuaagucagcuucauuguucauaugaaucuuuugauguagaaucaggaguuuacagcguuucaaguuuugaagccaaaccuucagguucaguagucgaacaagccgaaggaguagaaugugacuucaguccccuucucaguggcacuccaccccaaguuuauaauuuuaaaagacucgucuuuaccaauugcaauuacaacuugacaaaauuacuuuccuuauuuucuguaaacgacuucacgugcucacaaauaucaccagcagcuaucgcaucaaauuguuacaguucuuuaauucucgauuacuucucuuauccauuaaguaugaaaucagacuuaucagucaguucagcaggaccgauaagucaauucaauuauaaacagucaucaucuaaccccacaugccuaauauuagcaaccguuccgcauaaccuaaccacaaucacaaagccauugaaauauagcuauauaaauaaaugcucuagauuacuuucagaugaucgaaccgaaguuccacaacucgucaacgcuaaucaguauucacccugcguuucaauagucccaucuacaguuugggaagacggggauuacuacaggaaacaacuuucaccacuagaaggagguggauggcucguagcgucagguagcacuguugcuaugaccgaacaauuacaaaugggcuuugguauaacuguacaauacggcacugacacuaauucaguaugccccaaacuggaauuugcgaacgauacuaaaauagcaucucaacuagguaacuguguagaauauuccuuauacggcguaagcgggcgcggaguauuucaaaacuguacagcagucgguguuagacaacaacgauucgucuacgacgcauaccaaaauuuaguaggauauuauucugacgaugguaacuauuacuguuuaagagccugcguguccguacccgucucagucauauaugauaaagaaacaaaaacucaugcaacucucuuuggaucaguagcaugugaacacauaucaagcaccaugagucaauauucucguucaaccagaucaaugcuuaaaagaagagauaguaccuauggcccacuccaaaccccuguaggauguguacugggucuaguaaauucuucacuauucguagaagauugcaaacucccauuaggucaaaguuuaugugcacuuccagacacccccucgacccuaacaccaagauccguacguucuguacccggagaaaugcggcuagcaaguauugcauuuaaucauccaauucagguugaccaauuaaauucuucauacuuuaaauuaucaauaccaacaaauuucuccuucgguguaacacaagaauacauacaaacaacaauacagaaaguaacuguagacuguaaacaauauguaugcaauggcuuccaaaaaugugaacaauuauuacgcgaauacggucaauuuugcucaaaaauaaaucaagcccuccauggagccaacuuaagacaggaugauaguguaagaaaucuuuuugcuucuguaaaaucuucccaaucgucgccaauaauuccuggauucggcggcgauuuuaaucucacccuauuagaaccaguauccauaucaaccgguuccagaucagccagaucggcuauagaggaccuccuauucgacaaaguuaccaucgcagauccaggauacaugcaaggauacgaugauuguaugcaacaaggaccggccuccgcucgugaucuuauaugcgcacaauacguagcagguuacaaaguacucccaccccuaauggauguaaauauggaagcagcuuacacaucgagccuauuaggaaguaucgcaggcguagguuggacagcaggccuaucaucuuuugcugccauccccuuugcccaaucaauauucuaccgccuuaauggaguugguauaacacaacaaguccucucggaaaaccaaaaguuaaucgcaaacaaauucaaucaagcucucggggcuaugcaaacugguuucacaaccacaaacgaggcuuuuagaaaaguccaagaugcuguuaacaacaacgcccaagcucuauccaaacuagcaagugaacuaucaaauacuuucggugcaauaucagcuucaauaggagauauuauacaacgacuagacguauuagaacaagaugcacaaauagaucguuuaaucaacgguagguuaacgacccuuaacgcuuucguagcccaacagcuaguucgcagcgaaagugcagcauugagcgcucaauuagcaaaagauaaaguaaacgaaugugucaaagcacaaucaaaaagaucgggcuuuuguggucaagguacucacauagucaguuuugucgucaaugcaccaaauggauuauacuuuaugcaugucgguuacuaucccucuaaccauaucgaaguaguauccgcuuacggccucugcgaugcagcuaacccaacaaacugcauagcuccuguaaaugguuauuuuauaaaaacaaauaacacuaggaucguugaugaaugguccuauacaggauccucauuuuaugcaccagaaccaauuacaucuuuaaauacgaaauauguagcaccucaaguaacuuaucaaaacauaucaacuaaccuacccccaccacuauuauccaauucaacagguaucgauuuccaagaugaacuagacgaauuuuucaaaaacguuucaacuucaauuccuaauuuuggcucccuuacccaaauaaauacaacauuacuugaccuuacauaugaaaugcuaucuuuacaacaagucgucaaagccuuaaacgaaaguuauaucgauuuaaaagaacuuggaaauuauaccuacuacaacaaauggccaugguauauuugguuagguuucauagcagggcuaguugcauuagcccuaugcguuuucuuuaucuuaugcugcaccggaugcggaacaaauuguaugggaaaauuaaaauguaauagguguugugaucgauacgaagaauaugaucuugaaccacacaaaguacacguacauuaa

SEQ ID NO: 1155 - RNA, 4062 nt, Artificial Sequence
  derived and/or modified CDS sequence (opt6) from MERS-CoV__ALA49451__S
augauucauucugucuuuuuauugauguucuuacuuacaccaacugaaagcuacguugacgucggucccgacucaguuaaauccgcuuguauagaagucgacauacaacaaaccuucuuugacaaaacauggccacgaccuauugacguaaguaaagcugauggaauaauauacccacaaggcaggaccuauuccaauauaaccauaacauaccaaggcuuauucccauaucaaggagaccauggagauauguauguuuacucugcuggacaugcaaccggcaccacaccucaaaaacucuucgucgcuaacuauagccaagauguuaaacaauucgcaaauggauuuguaguacguauuggugcagccgcuaauucaacaggaacuguaaucauuuccccuagcacaucagcaacaaucagaaaaaucuaccccgcauucauguuaggaagcuccgucggcaacuucucugauggaaaaaugggaagauucuuuaaucauacucucguacuauuaccagauggauguggcacacuacuucgagcauucuauugcauccuagaaccuagaucaggaaaucauuguccagcuggaaacucguacaccagcuuugcuacauaccacacaccagcaacagacugcucagacggcaacuauaaucguaacgcaucauugaauaguuuuaaagaauacuucaaucuuagaaauugcacauuuauguacacuuauaauauuaccgaagaugaaauacuugaaugguuugguauuacccagacugcacaaggaguacaccuauuuucaucacgauacguugaccuauacggagguaauauguuucaauuugcgacauuaccagucuacgauacaauuaaauauuauucuauuauuccucauucuauaagaagcauccaaagugaucguaaagcaugggcagcauuuuauguauacaaacuccaaccccuaacauuccucuuagauuuuucaguugacgguuauaucaggagagcaauagauugugguuuuaaugaucugagccaacuacacuguagcuaugaaaguuucgacguagaaucuggaguauauucaguauccagcuuugaggccaaaccuagcggaagcguaguugaacaagcugaaggaguagagugugauuucucuccacuacuaucaggcacaccuccucaaguuuacaacuucaaacggcuagucuuuacuaauugcaacuauaaccuaaccaaacuucucucauuauuuuccgucaacgauuuuacauguucccaaauuuccccugcugccauugccuccaacuguuauagcucucucauccuagauuauuuuagcuauccccuaucaaugaaaucugauuuaucuguuucaucagccggaccuauuagccaauucaacuauaaacaaucuuucucuaauccuacaugucucauuuuagcuacagucccccauaauuuaacaacaaucacaaagccacuaaaauauaguuauauuaacaaaugcucacgcuuauuaucggacgaucgcacggaaguuccccaauuaguaaaugcuaaucaauacaguccuugcguauccaucguaccaaguacaguaugggaggauggcgacuacuauagaaaacaacuaucucccuuggaagguggaggcuggcuuguagccaguggcucgacuguagcaaugacagaacaacuacaaauggguuucggaauaacaguccaauauggaacagacacuaacaguguuugcccaaaacuagaauuugcuaacgauacaaaaauagcaucgcaacucgguaacuguguagaauauucccuauaugguguuucaggaagaggaguuuuucaaaauuguacggcaguagguguuagacaacagcgcuuuguauacgaugcuuaccagaaucucguaggcuacuauagugaugacggcaauuauuauugccuaagagcauguguaucaguaccaguaucagucauuuacgauaaagaaacaaaaacucaugcaacacucuucggaucagucgcuugcgaacacauuucuucuaccaugucccaauacucaagaucaacccguaguaugcucaaaagacgagauucuacuuauggaccauuacaaacuccagucggaugcguucucggccuagugaacucaucucuauucguagaagauugcaaucuuccauuaggucagucccuaugugcauugccugauacaccauccacacuaacaccacgaagugugagaucggugccaggagaaaugagguuagccucuaucgcauucaaucacccaauucaaguagaucaacuaaacuccucauauuucaaguuaagcauuccuacuaacuuuagcuuugguguuacacaagaauauauacaaaccacuauucagaaaguaacaguugacugcaaacaauacguuugcaauggcuuccaaaagugcgaacaacuucuucgcgaauacggacaauuuuguucuaaaauaaaucaagcacuucacggcgccaacuuaagacaagaugauuccguuagaaaucucuuugcuucagucaaaagcucacagaguucaccuauaauaccuggauuugguggagauuuuaauuugacauugcuagaaccuguaucuauaucaaccggaucacgguccgcaagaagcgcuauagaagaccuccuauucgacaaaguuaccauagcagacccgggcuauaugcaaggauacgaugacuguaugcaacaaggaccugcauccgcacgcgaccuaauuugugcucaauauguagcagguuauaaagugcuaccaccucuaauggauguuaacauggaggcagcuuacaccagcucccuacuugguucaauugcgggagucggauggacagcaggauuauccucuuuugcagcgauccccuucgcccaaucuaucuucuaucgauuaaauggcguaggaauaacacaacaaguacugagugaaaaucagaaacuuauagcaaacaaauuuaaucaagcacucggggcaaugcaaacaggauucacaaccacaaacgaagcauuuagaaaaguacaagaugcaguuaacaauaaugcacaagcgcuaucaaaacuagcuucugaacuauccaauaccuucggcgcaauauccgccucuauaggagauauaauacaaagauuagauguccuggaacaagaugcucaaaucgauagauuaauaaauggaagacuuacaacucucaaugccuucguagcucaacagcuagucagaucagaaagugcugcacuuucagcacaacuugcuaaggauaaaguaaacgagugugucaaagcacaaucgaaaagaucugguuuuugcggucaaggaacucauaucgucagcuucguaguuaaugccccuaacggauuguacuuuaugcaugucggauauuauccaucaaaucacauagaaguuguaucagcauauggauugugugacgcugcaaacccaacaaauuguauagcaccaguuaacggcuacuucauaaaaacaaauaauacucgcauaguugaugaaugguccuacacagguucuucauucuaugcuccagaaccaaucacaucucuaaauacuaaguauguagcaccucaaguuacuuaccaaaauauaagcacuaaucuacccccuccacuauuaggaaauagcacugggauagauuuccaagacgaacucgaugaguucuucaagaauguaucuacaaguauccccaacuucggaagccuaacacaaauaaauaccacccuauuagacuuaaccuaugaaauguuaucauuacagcaaguagucaaagcacuaaacgaauccuauauagaucuuaaagaacuuggaaauuacacuuauuauaauaaguggccaugguacauauggcuaggauuuauagcaggccuagucgcccuugcucucuguguauucuucauucuuuguugcacuggaugcggaaccaacugcaugggaaaacuaaaauguaaucguuguugcgauagauacgaagaauaugaccucgaaccucauaaagugcauguacacuaa

SEQ ID NO: 1156 - RNA, 4062 nt, Artificial Sequence
  derived and/or modified CDS sequence (opt6) from MERS-CoV__ALA49473__S
augauacacucaguauuucuacucauguucuuacuaacaccaacagaaucauacguugauguugguccagauuccguuaaaucugcaugcauugaaguagauauccaacaaaccuuuuucgauaaaacauggccuagaccaauagauguuucuaaagccgauggcaucauauacccacaaggccgcacguacagcaauauaacaaucacauaccaaggacuuuuuccauaccaaggggaucacggugauauguacguuuauucagcaggucacgcuacaggaaccaccccucagaaauuauucguagccaauuauucccaagauguuaaacaauuugcaaacgguuuuguugugcgaauuggagcagcagcaaauucaacuggcacaguaauuauuucuccuucaacaucugcaacuauaagaaaaauuuaucccgcuuucaugcucggauccucuguaggaaauuuuucugacggaaaaaugggacgcuucuuuaaccauacucucguacuauuaccagacgguugcggaaccuuacuacgugcuuucuacuguauacuugaaccaagaucaggcaaucacugccccgcaggcaauucauauaccucauuugcuacauaucauacccccacgacagacuguucugacggaaacuauaauagaaacgcaucguuaaauucuuuuaaagaauauuuuaaccuccgcaauuguaccuuuauguacacauacaacauaacugaagaugaaauacuugaaugguucggaauaacucaaacggcucaaggaguucaucuauuuagcucacgauauguagaccuauacggcggcaacauguuucaauuugcaacucuacccgucuaugauacuauaaaauauuauucaauuauaccccauagcauaagauccauacagucugaccgaaaggcaugggcagcuuucuauguauauaaacuacaaccauuaacauuuuuacuggauuucagcgucgacgguuacauccgacgugcaauugacuguggguucaaugauuuaucccaacuucauuguucuuacgaaaguuuugauguagaaucaggugucuauucaguaucaaguuuugaagccaagccaucuggcucaguaguugaacaagcagaaggaguagaaugugacuuuucaccccuacuauccggcacaccuccacaaguauauaacuuuaaacgccuagucuuuacaaacuguaauuauaauuuaacuaagcuacucagcuuauuuucuguaaaugacuucaccuguucccaaauuucacccgcagcaauagcauccaauugcuauuccaguuuaauucuagacuauuucucuuauccgcuaagcaugaaaagugaucuaaguguaucaucugcuggccccauaucucaauucaacuauaaacaaucauuuaguaauccuacauguuuaauacuagcuacgguuccccauaauuuaacaacaauaacuaaaccuuuaaaguacucauauauaaauaaaugcucuagacuucuuuccgacgauagaaccgagguuccccaguuaguaaaugcaaaccaguacuccccuuguguuaguauugucccuucuaccguaugggaagauggcgauuauuaucgcaaacaacuuagccccuuagaaggaggcggcuggcucguagcgucaggcucuaccguagccaugacagaacaacuucaaaugggauucgguaucacuguacaauacggaacugacacaaauucuguuugcccaaaacuagaauuugcuaacgauacaaaaaucgcuucgcaacuaggaaacugcguagaauauucucuuuacggaguuucuggacgaggaguuuuucaaaacugcacugcugucggaguaagacaacaaagauuuguauaugacgccuaccaaaaccuuguuggauauuauucagacgacggcaacuacuacugcuuaagggcaugcguuagcguacccguaucugucauuuaugauaaagaaacaaaaacacaugcuacacucuuuggaaguguugccugcgaacacauaagcuccacaaugucccaauauucacguuccacaagaucaaugcuaaaacgucgagauucaaccuaugguccauuacaaaccccaguuggcugcgucuuaggccucguaaacucuucauuauucguagaagacugcaaauuaccucuaggacaaucauuaugugcccuaccagauacucccucgacacuuacccccagaucaguucgaaguguccccggagaaaugagauuagcaucaauagcauuuaaucacccaauccaaguagaucaacuaaacucgucauauuucaaacucaguauaccuacuaacuuuucauuuggaguuacacaagaguauauacaaaccacuauacaaaaaguuacagucgacugcaaacaauacguaugcaacggcuuucaaaaaugugagcaauuacuacgagaauacggccaauucugcucaaaaauuaaccaagcucuacacggagcaaacuuacgacaagacgacagugucagaaaucucuucgcaucagugaaaucgucucaaucuucaccgauaauaccaggauuuggaggcgauuuuaaucuuacccuacuagaaccaguuucaauauccaccggaagucgaucugcacgaucugcaaucgaagaucuuuuauucgacaaagucacuaucgcagacccugguuacaugcaagguuacgacgauuguaugcaacaaggaccugccucagcgcgugaucuaauaugugcacaauauguagccggguacaaaguucuuccuccccugauggacguuaauauggaggcugcauauacaagcucguuacugggaaguauugcaggagucggcuggaccgcugggcuuucuucauuugccgcaaucccguuugcacaaucaaucuucuaucgauuaaauggaguaggcauaacucagcaaguccucuccgaaaaucaaaaacuaauagccaacaaauuuaaucaagcucucggagcuaugcaaacugguuuuacaaccaccaacgaagcauucagaaaaguacaagaugcugucaacaacaaugcacaagcacugucuaaauuagcaucagaauuaucuaauacguuuggagccaucuccgcauccaucggcgacauaauacaaagacuagacguccuagaacaagaugcacaaauagaccggcuaaucaacgguaggcucacuaccuuaaaugcauucguagcacaacaauuaguacguagugaaucagcagccuuauccgcacagcuagcuaaagauaaaguaaacgaaugcgucaaagcucaaucuaaaagaucuggauucuguggccaagguacucauauugucuccuuuguaguaaacgccccaaauggccuuuauuuuaugcauguaggcuauuacccaucaaaucauauugaaguuguauccgcauauggauuaugcgacgcagccaaccccacaaacuguauagcacccguaaacggauauuucauuaagacaaauaauacuagaauagucgaugaauggucguauacaggaucauccuuuuaugcuccagaaccaauuacaucauuaaauacuaaguauguagccccacaaguaacuuaccaaaacaucagcacaaauuuaccuccaccccuauuaggaaauucuaccgggaucgauuuucaagacgaacuagaugaauuuuucaaaaaugucagcacaucuauacccaauuuuggaagucuuacccaaauaaauaccacucuucuagauuuaacuuaugaaaugcucagcuuacaacaaguuguaaaagcacucaaugaaucguacauagaccuaaaggaacugggaaacuauacauauuauaauaaauggccaugguauaucugguuagguuuuaucgcaggucuggucgcccuagcucuauguguauuuuucauacuauguuguacugguuguggaacaaacuguauggguaaacuaaaauucaauagauguugugauagauacgaagaauaugaucuugagccucauaaaguacacguucacuaa

SEQ ID NO: 1157 - RNA, 4062 nt, Artificial Sequence
  derived and/or modified CDS sequence (opt6) from MERS-CoV__ALA49583__S
augauacauucaguuuuccuucuaauguuuuuauuaacaccuacugaaagcuacguugauguagguccggacuccguuaaaucugcauguauagaaguugacauacaacaaaccuucuuugacaaaacauggccacgaccaauagauguaucaaaagccgacgggauuaucuauccccaagguagaacuuauuccaauaucacgaucaccuaucagggccuuuuuccuuaccaaggagaucacggagauauguacguauauucugcuggccaugcgacaggaacaacuccccaaaaauuauuuguagcaaacuacucccaagauguuaaacaauuugccaauggcuuuguuguuagaauaggagcugcugcaaacaguacaggcacuguaauaauauccccaaguaccagcgcaacaauacgcaaaauuuauccagcauucaugcuagggaguucaguuggcaacuucagugauggaaaaaugggacgauuuuucaaucauacauuagucuuacugccagauggaugcggaacuuuauuaagagccuucuauugcaucuuagaaccccgcucuggaaaccacuguccggcaggaaacucauacaccaguuuugcuacauaucacacacccgcaaccgacuguagugauggaaacuauaacagaaacgcuucucuuaacucauuuaaagaauacuucaauuugcguaauuguacuuuuauguacacauauaacauuacugaagaugaaauacuagaaugguucggaauuacacaaacugcacaaggaguccacuuauucucaagucgguauguugauuuauacggcggcaauauguuucaauuugccacuuuaccuguuuacgacacaaucaaauacuacucaaucaucccacauaguauuagaucaauccaauccgacagaaaggcaugggcugccuuuuacguauauaaauuacaaccauuaacuuuucuacuagacuucuccguagauggauauauccguagagcaauugauuguggauucaaugaccugucacaacuccauugcucauaugaauccuucgacgucgaaucagggguauauucgguaucuucauuugaagccaaaccuucuggcucugucguagaacaagcugaaggaguugaaugcgauuucucaccucugcuaucagguacuccuccacaaguuuacaauuucaagcgacugguuuucaccaauugcaauuauaaccuaacgaaacuauuaaguuuauuuucgguaaaugacuuuaccugcucacaaaucaguccugcugccauugcaucuaauugcuauucaagccuaauucuugauuauuuuucauauccauuaagcaugaaaagugaucuaucuguaaguuccgcaggaccaauaucacaauuuaacuauaaacaaucauuuuccaauccaaccugucuaauuuuagcaacgguaccacauaaucuaacaacuauaacaaaaccacucaaauacucauacauuaacaaauguagccgucuucuuuccgacgauagaacagaaguaccacaauuaguaaacgcaaaccaauacucuccauguguauccauaguaccaucuacugucugggaagauggagacuauuauagaaaacaauuaucuccuuuagaaggaggcggauggcuaguggccucaggaucaacaguagcuaugacugaacaacuacaaaugggcuucggaauaaccguucaauaugggacggauacuaacucugucuguccuaaacuugaguucgccaacgauacuaaaauagcaucacaacuugguaauugugucgaauauucucucuauggaguuucaggccgcggaguauuucaaaauuguacagcagucggugugagacaacaaagauuuguuuaugaugcuuaccaaaaccuagucggauacuauucagaugacgguaacuacuacugucuucgcgcaugcguaucaguuccaguaucagugauuuacgauaaagaaacaaaaacacacgccacuuuauucggaaguguugccugcgaacauauaucaucaaccaugucacaauacucaagaucaaccagaaguaugcuuaaacgaagagacucaacuuacggaccccuucaaacuccuguuggauguguauuaggccuaguuaacuccucuuuauuuguagaggauuguaaacucccucuaggacaaucauuaugugcuuuacccgauacuccuucaacuuuaacaccccggaguguaaggaguguuccaggugaaaugagacucgcaucuauagcuuucaaccacccuauccaaguagaucaauuaaacucaucauacuuuaaacuaucaauacccaccaacuuuaguuucggagucacucaagaauauauccaaacuacaauccaaaaggucacuguagacuguaaacaauauguauguaaugguuuucaaaaaugugaacaacuccuucgagaauauggacaguucugcuccaaaauuaaucaagcacuacacggcgcaaacuuacgacaagaugacucaguaagaaauuuguucgcauccguaaaaucgucgcaaagcuccccaauuauuccuggauuuggaggcgauuucaaucuaacucuacuugaaccugugucuaucucaacaggcucaagaucagccagaucagcaaucgaagaccuacuuuucgauaaaguuacaauugcugaccccggauauaugcaaggauaugaugauugcaugcaacaaggacccgcuucggcacgagaccuaauaugcgcucaauacguugcagguuauaagguccuaccaccccuuauggacguaaauauggaagcugcauacacaucaucacuccucggaaguauugcaggcguaggcuggaccgcaggacuuucaaguuuugcugcaauuccauuugcccaaucuaucuucuacagacuuaauggaguagguauuacccaacaaguccucuccgagaaccaaaaacuuauagcaaauaaauucaaucaagcauugggugcuaugcaaacuggauucacaacuaccaaugaagccuucagaaagguacaagacgcaguaaacaauaacgcacaagcacuauccaaauuagcaucugaauuauccaacacuuuuggagcuauaucggccucuauuggcgauauuauacaacgcuuagacguuuuagaacaagaugcacaaauugauagacuaaucaauggccgacucacaacgcuaaaugcauuuguagcacaacaacuuguccgaucagaaagugcagcauuaucugcacaguuagccaaggacaaaguaaacgaauguguaaaggcucaaucuaaacgaucaggauuuuguggacaaggaacacauauaguuucauuuguugucaacgcaccaaauggacuuuauuuuaugcaugucggauacuauccaucuaaucauaucgaagugguuucagcauauggucucugcgaugcagcaaacccgacaaauugcauagcaccugucaaugguuacuucaucaaaacgaauaauacacgcauaguugaugaauggagcuacaccgguucuucuuucuaugcaccugaaccaauaaccucacuuaauacaaaauacguagcuccccaggucacuuaucagaauaucucaacuaaucuacccccaccauuauuaggaaauucuaccgguauagacuuccaagaugaauuagaugaauuuuucaaaaauguaagcaccaguauaccuaacuuugguucauuaacgcaaaucaacacaacccucuuagaccuaacauacgagaugcuaucacuacaacaaguagucaaagcacuuaaugaaucauauaucgaucucaaagaauuaggaaacuauacauauuacaacaaauggccuugguauauuuggcuaggauuuauagcugggcuaguugcguuagcacuuugcguauucuuuauacuauguuguacaggaugcggcaccaacugcaugggaaaauuaaaguuuaaucgguguugcgaucguuaugaagaauacgaucuugaaccccauaaaguucauguucauuaa

SEQ ID NO: 1158 - RNA, 4062 nt, Artificial Sequence
  derived and/or modified CDS sequence (opt6) from MERS-CoV__ALA49649__S
augauacauagugucuucuuacuuauguuccuccucacaccuacagaaucauacguugaugucggaccagauucaguaaaaucugcaugcauagaaguagauauacaacaaacauucuuugauaaaaccuggccaagaccuauagacguaucuaaagccgacggcauaauauacccacaaggaagaaccuauuccaauauaacaauuacauaccaaggacuauucccauaucaaggugaucacggugauauguaugucuacagugcaggacacgcaacaggaaccacacccaagaaacuauucguagcaaacuauagucaagauguuaaacaauuugcaaacggcuuugucguacgcaucggagcagcagcaaauaguacaggaacuguuauuauuucucccucaacuucagcuaccauccgcaaaaucuauccagccuuuauguuaggaucuucaguaggaaacuuuucagauggcaaaaugggucguuucuucaaccauacacuuguucuucuuccugauggauguggcacacuccuacgagcguucuacugcauccucgaacccagaucuggaaaucacugccccgcgggcaauuccuacaccuccuuugcaacauaccauacgccagcuacggacuguucagauggaaacuauaacaggaaugcuucucuaaacucauucaaagaauacuuuaaucuuagaaauuguacauucauguauaccuauaauauaaccgaagaugaaauacuagaaugguucggaauaacccaaacugcacaagguguucaccuuuucucaucgcgauacguagauuuauauggaggcaacauguuucaauucgcaacauuaccaguauaugauacaauaaaauauuacucaauaauaccacacaguauacgaucaauacagagcgaucgcaaagcaugggccgcuuucuaugucuauaaauuacaaccauuaacuuucuuacucgacuuuucgguugacgguuauauuagacgcgccauugacugcggauuuaaugacuuaucucaacuacauuguucauaugaaucauucgacgucgaauccgguguauauucaguaucaucauuugaagcaauuccaucaggcuccguaguagaacaagcugaagguguagaaugugauuuuucaccccuccugucaggcacuccaccacaaguuuauaauuucaaaaggcuaguuuuuacaaauugcaacuacaauuugacaaaacuauuaucucuuuucucagucaaugauuuuacauguucacaaaucucuccugcugcuauagcuucuaauuguuauuccucuuuaauacuugacuacuucucauauccacuaucuaugaaaucagacuuaucgguaucaucagccggaccgauaucacaauuuaacuacaaacaaaguuuuucaaacccaaccuguuuaauacuugcuacaguuccacauaaucuaacgacaauaacuaaaccucuaaaauacucauauauaaacaaauguucuagauuacucucugacgauagaacagaagugccacaacucgugaaugcaaaccaauacuccccuugcguaucaauagucccaucgaccguuugggaagauggcgacuauuacaggaaacaauuaucaccuuuagaagggggagguuggcucgucgcaucugggucuacuguagcaaugacagaacaacugcaaaugggauuuggaaucacaguucaauauggcacugauacaaauucaguuugccccaaacucgaauuugccaaugauaccaaaauagcaagucaacuuggaaauuguguugaauauucacuguacggaguaucaggacgugguguauuccaaaauugcacagcagucggaguaagacaacaacgcuuuguauacgacgcauaucacaaccuuguuggauacuauuccgacgauggcaacuauuacugccugagagcaugugucagcguaccuguaaguguaauauacgacaaagaaacaaaaacccaugccacacuuuuugguucagucgcaugcgaacauauuucauccacgaugucucaauacagucgaucaacacguucuaugcuaaaaagacgagauuccacauacggacccuuacagacaccgguaggcuguguccuuggccuaguaaacucuagcuuauuuguagaagauuguaaauuaccccucggacaauccuuaugcgcccuuccagacacucccucaacucucacaccaagauccguucgaucagucccaggagaaaugagacuagcuucuauagccuuuaaucaucccauccaaguagaccaguuaaauagcucauauuuuaaacucuccauaccaacuaacuucucauuuggcguaacgcaagaauauauccaaacuaccauacaaaaaguaacuguagacugcaaacaauauguuugcaacggauuccaaaaaugcgaacaauugcugagggaauacggucaauucugcaguaaaauaaaucaagccuuacacggcgcuaaucuacgucaagaugacucaguuagaaaucuauuugcgagcguaaaauccucccaaucuucgccuaucaucccugguuuugguggggacuucaacuuaacacuucucgaaccaguaucuauaaguacgggaucaaggucugcaagaucugcaauugaagaucuacuauucgauaaagucacuauagcagacccaggcuacaugcaaggauacgacgacugcaugcaacaaggaccagccucagcacgcgauuuaauaugcgcgcaguauguugcggguuauaaaguucuaccuccguuaauggacguaaauauggaagccgccuacacaaguagcuuacuagguuccauagccgguguaggcuggaccgcaggccuaaguucauuugcagcuauacccuuugcccaaucaaucuuuuacaggcuaaacggagucgguauuacucaacaaguauuaucagaaaaucaaaaacuuauugccaacaaauucaaccaagcccucggagcaaugcaaaccggauuuacuacaacuaacgaagcauucagaaaaguacaagaugcaguaaauaacaaugcucaagcauuaaguaaacuagcaucagaauuaucaaauacguucggcgcaauuagcgcgaguaucggugacaucauucaaagacuagauguccuagagcaagacgcacagauugauagacuaaucaacggaagauuaacaacacucaacgcauucgucgcacaacaauugguaagaagugaauccgcugcucuaucagcccaauuagcaaaagacaaaguuaacgaauguguaaaagcacaaucaaaacgaucaggauucuguggccaaggaacccauauagucucuuucguagucaaugcaccaaacggccuauauuucaugcauguagguuauuacccaucuaaucauaucgaaguaguaucggccuauggauugugugaugcagcaaaucccacaaacugcauagcaccugucaauggcuacuuuauaaaaacaaauaacacucgaauuguagacgaauggucauauacaggaucuucuuuuuaugcaccugagcccaucaccucgcuaaauacaaaauauguugcgccacaaguaacuuaccaaaacauaaguaccaaucuuccgccaccacucuuaucuaacucaacaggcaucgauuuccaagaugaacuugaugaguucuuuaaaaauguaucuaccucuauaccaaacuuugguaguuuaacacaaauuaauacaacuuuauuggacuuaacuuaugaaauguuaucuuuacagcaggucguaaaagcucuaaacgaaagcuacauagaucuaaaagaacucggaaacuacacauauuauaauaaauggccaugguacauaugguuagguuucauagcuggccuaguugcccucgccuugugcgucuucuuuaucuuauguuguacaggauguggaacuaacuguaugggcaaacuaaaauguaauagaugcugcgauagauaugaagaauacgaccucgagccacacaaaguccauguccauuaa

SEQ ID NO: 1159 - RNA, 4062 nt, Artificial Sequence
  derived and/or modified CDS sequence (opt6) from MERS-CoV__ALA49660__S
augauacauucaguguuccuuuuaauguuucuccuaaccccaacagaauccuauguugaugugggccccgauagcguuaaaucagcaugcauagaaguagauauacaacaaacauucuuugauaaaacauggcccaggccaauagacguaagcaaagcugauggcauaauauauccacaaggucgcacauauucuaauauaacuauaacuuaccaggguuuauuucccuaccaaggugaucacggggauauguacguauacucagccggacaugcaaccggaacaacaccacaaaaacuuuucguugccaauuacagucaagacguaaaacaauucgcaaacggauuuguaguuagaauuggugcagccgcuaauucgaccggaacaguuauuauaagcccuuccacauccgcuacuauuagaaaauucuauccugcauuuaugcuugguucgaguguaggcaacuuuuccgauggaaaaaugggaagauucuuuaaccauacucuuguauuauuaccugacggcuguggcacacucuuaagagccuucuauuguauucuugaaccuagauccgguaaucauuguccagcagguaauuccuauaccuccuucgcaacguaucauacacccgcaacugauuguucagauggaaauuacaaucgaaacgcauccuuaaauucuuuuaaagaauacuucaaccuaagaaacuguacauuuauguacacguacaauauaacagaagacgaaauacuagaaugguuuggaauaacucaaacagcccaaggaguccaccuauuuagcucccgauauguagaccuauauggcggcaauauguuccaauuugcgacacuaccugucuacgacacaauaaaauacuauucaaucauaccccauucaauacguagcauucaauccgaccgaaaggcuugggccgccuucuacguuuauaaauuacaaccucucacuuuccuccuagacuucucuguagauggguauauacgccgggcaauagauugcggcuuuaacgacuuaagucagcuacauuguuccuaugaauccuucgauguagaaucugguguauacagcguauccucuuucgaagcaaaaccgagcgguagcguaguagaacaagcugaagguguagaaugugauuucuccccucuacuaucagguacaccaccacagguauacaacuuuaaacgucuaguauucacaaauugcaauuacaaucucaccaaacuucucucgcuauuuuccguuaacgacuuuacuugcucgcaaauauccccugcugcaauagcuucaaacugcuauucuagccucauauuagauuacuucucuuacccccuaucaaugaaaucagacuuaagcguaaguuccgccggccccauaagccaauuuaacuauaaacaauccuucucaaauccaaccugccuaauauuagcaaccguuccccauaacuuaacaacaauaaccaaaccauuaaaauacucuuauauaaacaaguguucgagauuacuuucugaugacagaacggaaguuccccaauuagugaacgccaaucaauauucgccauguguauccauaguaccuucgacaguaugggaagacggagauuauuaucgcaagcaauuaaguccccuugaaggaggaggaugguuagucgcuucaggaucgacaguagcaaugaccgaacaauuacagaugggauuuggaauuacuguccaauacggcacagauacaaacucaguauguccaaaacuagaguucgcaaaugauacaaaaauagcaagucagcucgguaauuguguagaauacucccucuauggagucucuggacgaggcguauuccaaaauuguacugcaguuggaguucgacaacaaagauuuguuuaugacgcuuaccaaaauuuaguuggauauuauucugaugaugggaacuacuacuguuuacgugcauguguaucaguaccuguaaguguuauauacgauaaagaaacaaaaacucaugccacuuuauuugguuccguagcaugcgaacacauaucaucaaccaugagccaauauagucgcaguacaagaucuaugcuaaagcguagagauagcacauacggaccauuacaaaccccaguuggaugcguauuaggccuagucaacaguucacuuuucguugaagacuguaaauuaccacuaggacaaaguuuaugugcucucccggauacaccuucuacccuaacgcccagaucaguaagaucugucccuggcgaaaugcgacuggcuucaaucgcauuuaaucacccaauucaagucgaccaauuaaauucuucguauuuuaaauuaucaauuccaacuaauuuuucauuuggaguaacccaagaauauauucaaacaacaauacaaaaagucacagucgauugcaaacaauacguaugcaauggauuccagaaaugugaacaacuacuccgggaauacggacaauucugcucaaaaauaaaucaagcauuacauggcgcaaacuuacgacaagacgauucuguaagaaaccuuuuugcuucaguuaaaaguucucaguccucgccaauaauaccaggauucgguggcgacuucaaucuuacauuacuagaaccugucuccauaucuacaggaaguagaagcgcucgaagcgcaauagaagaucucuuauuugauaaaguaacaauugccgaucccgguuacaugcaaggcuacgacgauuguaugcaacaaggaccugcuucagcaagagaccuaauuugugcacaguauguagccggcuauaaaguauuaccuccacuaauggacgucaacauggaagcagcauacacaucuucauuauuaggauccaucgcaggcguagguuggaccgcaggccucucaucuuucgcagcuauaccguuugcccaaucaauauuuuaccgauuaaacgguguaggaauuacucaacaagucuuaagugauaaucaaaaacuaauagcuaacaaauuuaaucaagcacucggcgcuaugcaaacagguuuuacuacaaccaacgaggcauucaggaaaguccaggaugccguaaacaauaacgcacaagcacuaucaaaauuagcaucggaauuaagcaacacauuuggcgcuauaagcgcuucuauaggcgauauaauccaacgcuuagacgucuuagaacaagacgcgcaaaucgacagguuaauaaacggccgacucacuacauuaaaugcauuuguagcacaacaauuaguacgcuccgaauccgcagcuuuaagugcucaacuagcuaaagacaaaguaaacgaguguguaaaagcacaaucaaaaagaucaggauucuguggacaggguacucacauaguaaguuucgucgucaaugcaccaaacggucuauauuuuaugcacguuggauauuauccuucuaaucauauagaaguaguuucugcauaugguuuaugugaugcugcgaauccuacaaauuguaucgccccaguaaacggauacuuuaucaaaaccaauaauacacgaauagucgaugaauggucuuauaccggaucaucauucuaugcuccagagccuauaacuucauugaauacuaaauauguagcuccacaaguaacuuaucaaaauauaagcacuaaccuucccccuccccuccuuucuaacucaacaggaauagacuuucaggaugaguuagacgaguucuuuaaaaaugucucaacuuccauuccuaauuucggcucuuuaacgcaaauaaauacaacucuacuagacuuaacuuaugaaaugcuaucucugcaacaaguaguaaaagcccuuaaugaaucauauauugauuuaaaagaacuaggaaauuauaccuacuauaacaaauggccaugguacauauggcucgguuucauugcagguuugguagcacuagcauuaugcguauucuuuauuuuauguugcacaggcuguggcacaaacuguaugggaaaacucaaauguaacagguguugugauagguaugaagaauaugauuuagaaccccauaagguacauguacacuaa

SEQ ID NO: 1160 - RNA, 4062 nt, Artificial Sequence
  derived and/or modified CDS sequence (opt6) from MERS-CoV__ALA49671__S
augauacacucaguauuucuacuaauguuuuugcuaacuccaacagaauccuauguugacguagguccugacucuguaaaaagugcaugcauugaggucgacauacagcaaacauuuuucgacaagacauggccacgacccauagauguuucaaaagccgacgguauuauuuacccacaaggacgaacauacucuaauauuacgauaacauaucaagguuuauuuccauaccaaggagaccauggagacauguaugucuauucugcaggccaugcuacaggaacaaccccucaaaaauuauuugucgcuaauuauucacaggacguaaaacaauuugcuaacggauucgucguucgcauaggcgcagcugccaauuccacuggaacaguaauaauaaguccuucaaccucugccacuauacgcaaaauauauccagcguuuauguuagguucauccguuggaaauuuuagugacggaaaaaugggacgauucuucaaucauacauugguauuacuaccagaugggugcggaacauuacuaagagcuuuuuauuguauccuagaaccucgauccggaaaccacugucccgcgggcaauucuuauacuagcuucgcuacuuaccauaccccugcaacuaauugcagcgacggcaauuauaaucgcaacgcauccuuaaauuccuucaaagaauacuucaaucuacgaaauuguacauucauguacacauacaauauaacggaagaugaaaucuuagaaugguuuggaauaacccaaaccgcacaaggaguucauuuauuuucaucucgcuacguugaccuauauggaggaaacauguuucaauucgcuacauuaccuguauaugauacuauaaaauauuacucaauuauuccacacaguauaagaaguauccaaucagacagaaaggcaugggcugcauuuuacguauauaaauuacaacccuuaacauucuuacuagacuuuucagucgauggcuacauuagacgcgcaauugacugcggauuuaacgaucuaucgcaauuacauuguucuuaugaaucauucgacgucgaaucagguguuuauucaguauccuccuucgaagcaaaaccuucaggauccguaguugaacaagcagaaggagucgaaugugauuucucuccauuauuaaguggaacuccaccucaaguauacaacuucaaacgacuuguauuuacaaauuguaauuacaacuuaacaaaacuacuuucucuauuuucuguaaaugacuuuacgugcagucaaauuucuccugccgcgaucgccucaaauuguuacucaucccuuauuuuagauuacuuuucuuauccuuuaucaaugaaaucugaccucucgguaucaucagcuggcccuauaucucaauuuaauuauaaacagucuuuuucuaauccgacuugucuaauacuugcaaccguuccccauaaucuuacuacaauaacaaaaccauuaaaguauagcuauaucaauaaaugcucucgacuauuaucagacgaccgcaccgaagucccccaacucguuaaugcgaaccaauauucaccuuguguauccauaguaccaucuacuguaugggaagauggagacuauuacagaaaacaacuaucgccuuuagaagguggcggauggcuaguagccucaggaucaacaguagccaugacggaacaacuucaaaugggcuucgggauuaccguacaauauggaacagacacaaauucaguaugucccaaacuagaauuugccaacgauacuaaaauagcuucacaacuagggaacuguguggaauauaguuuguacggagugagcggucgaggaguauuccagaacuguacagcagucggagugcgucagcaaagauuuguauacgaugcauaucaaaauuuggucggcuauuauagcgacgauggcaauuauuauugucuacgugccugcgucucuguucccguaucugugaucuaugacaaagaaacaaaaacucacgcaacauuauucggauccguggcuugugaacacauauccucaacaaugucccaauauucucguagcacccggucuaugcuaaaacgucgagacucuaccuacggcccccuacagacuccugugggauguguacuaggauuagucaauagcucccucuucguagaggacuguaagcuaccgcucggacaaaguuuaugugcguugccagauacuccuucaacacuuacaccacguucaguaagaucuguaccuggugaaaugcgucuugcuucuauugccuucaaccacccaauucaagucgaccaacuuaauucgucauauuucaaacuauccauuccuaccaacuuuucauucggcguaacucaagaauacauacaaaccacuauacaaaaagucaccguggacuguaaacaauacgucugcaauggauuccaaaaaugcgagcaauuacuacgagaauacggucaauucuguucaaaaauaaaucaagcucuacacggugcaaacuuaagacaagaugauagcgucagaaaccucuuugcgucaguaaaaaguucacaaucuagucccauuauuccaggauucggaggagacuucaacuugacacuucuagaaccgguaucuaucaguacagggucaagaucagcaagaucugccaucgaagacuuauuauuugauaaaguaacaauugcagacccaggauacaugcaagguuaugaugacuguaugcaacaaggcccagcaucagcucgagaccuuauaugugcucaauacgucgcuggauauaaaguucuacccccauuaauggauguaaauauggaagcugccuacacuucuucucuuuuaggaucuaucgccggcguagguuggacugcaggacuuucuucuuuugcugcaauuccuuuugcccaaucaauauuuuaccgauuaaacgguguuggaauaacacagcaagucuuaucagauaaccaaaaauuaauagcaaauaaauuuaaccaagcucuaggagcuaugcaaaccggcuucacuacaacuaacgaagcauuccguaaaguacaagacgcgguaaauaacaacgcucaagcccuuucuaaacuagcuuccgagcuuaguaacacauuuggagcaauuucugccucaauuggugauauaauucaacguuuagauguucuagaacaggaugcacaaauagacagacuaauaaauggucgacucacaacuuuaaaugcauuuguugcgcaacaauuaguaaggucagagucugcagcuuugucagcccaauuagcaaaagacaaaguuaacgaauguguaaaagcacaaucuaaacgauccggcuuuuguggucagggaacacacauuguaucauuuguuguaaacgcuccaaauggacucuauuucaugcauguaggauauuacccuucgaaccacaucgaaguaguaucagcauacggacucugcgaugcagcuaaucccacaaauuguauugcaccuguaaacgguuacuuuauuaaaacaaauaauacucgaauuguagacgaauggucauauaccggcaguucauuuuacgcuccagaacccauaacaucacuuaauacuaaauauguggccccucaaguuacauaucaaaauauuagcacuaaccucccuccuccuuuacuaucaaauucuacuggcauagacuuucaagaugaacuagaugaauuuuucaaaaauguaaguacgagcauaccgaauuuuggaucacucacacaaauaaacacaacauuauuagaucugacauacgaaauguuaagucuacaacaaguuguaaaagcauuaaaugaaucauauauagaucugaaagaacuaggaaacuacaccuacuauaacaaauggccuugguauauauggcuaggauuuauugcuggacucguagcccucgcauuaugcguuuucuuuauucugugcuguacaggaugcggcacaaauuguaugggaaaacugaaauguaaccggugcugugacagauacgaagaauaugaucuagaaccucauaaaguccacgugcacuaa

SEQ ID NO: 1161 - RNA, 4062 nt, Artificial Sequence
  derived and/or modified CDS sequence (opt6) from MERS-CoV__ALA49682__S
augauacauucaguauuuuuauuaauguuuuuacuaacuccuaccgaaucauacgucgauguuggaccugacuccguuaaaucugccugcauugaagucgacauucagcaaacauucuuugauaaaacuuggcccagacccauugauguaucaaaagccgacgggauaauauauccacaaggaagaacuuauaguaacauaacaauaacuuaucaaggucuuuuuccauaccaaggugaucacggggacauguacguauauuccgccggacacgcuacuggaaccacaccucaaaaacuguuugucgcaaauuauucccaagauguaaaacaauuugcaaacggguuuguuguacguauaggagcagcugcaaacuccaccggaacagucaucauuucaccaucuacauccgcaacgauacgcaagauauacccagcauucauguuaggaagcucaguaggcaauuucagugaugguaaaaugggaagauuuuucaaucacacacuuguauuacucccugaugguugcgguacauugcuucgugcauuuuacuguauacucgaaccuagaagcgguaaucacugcccugcuggaaauuccuacaccagcuucgcuacuuaccauacacccgcgacugacuguucugaugggaacuauaacagaaacgcaucacuaaauucauuuaaagaauauuuuaauuuaagaaacugcacuuuuauguauacauacaauauaacugaagaugaaauccuugaaugguucggcauuacacaaacugcacaaggaguccaucuauuuucuucacgauacguagaccuauacgggggaaauauguuucaauuugcaacuuuaccagucuaugacacaauuaaauauuacucuauaauaccacacuccauucgaucuauacaauccgaccgcaaagcaugggcagcauucuacguuuacaaauuacaaccuuuaacuuuccuauuagauuucaguguagacgguuauauaagacgcgcaauagauugugguuuuaaugaucugucacaauuacacuguucauacgaaucauucgacgucgaaagcggaguauacucaguuucgagcuuugaagcuaaaccaucaggaucaguaguugaacaagcagagggcguugaaugcgauuucucaccauuauuguccggcacaccaccucaaguauauaauuuuaaacgauuagucuuuacaaauugcaauuacaaccuuacaaaacuccucucacucuucucaguaaacgauuuuacaugcagucaaauaucaccagccgcaauagccuccaauuguuacucaucauuaauauuagacuacuuuucuuacccacuaucaaugaaaagcgacuuauccguuucuagcgccggcccuaucucacaauuuaacuauaaacaauccuucucaaacccaacuuguuuaauacuagccacaguuccccacaaucucacgacaauaaccaaacccuuaaaauacucauauauaaauaaguguucuagauugcuaucagaugaccguacagaaguaccucagcuaguuaacgcaaaccaauacucaccauguguaaguauaguaccaucaacaguaugggaagauggagacuacuauagaaaacaacugucuccauuagaaggaggaggaugguuaguagccucugguucaacaguagcaaugacagaacaacuacaaaugggauuuggcauuaccguacaauacgguaccgauaccaauaguguauguccaaaauuggaauuugcuaaugacacgaaaauugccucgcaauuaggaaauuguguagaauauucuuuauacggagugucaggaagaggcguauuccaaaacuguacagcaguaggaguacgacaacaaagauuuguuuaugaugcuuaccaaaaccucguaggauacuauucagacgacggcaauuacuacugucuucgcgccugcguuucugucccuguaagcguuauuuacgauaaagaaacaaaaacucaugcuacgcuauucgguucuguggcaugugaacauauaaguucaacuaugagccaauauucacgaaguaccagaucaaugcucaaacggagggauucaacauauggaccauuacaaacaccaguaggauguguccuuggccuuguaaauucaagccuauucguagaagacuguaaauuaccccucggacaaucucuuugcgccuuaccagacacaccauccacacuaacaccaagaucaguuagaagugucccaggagagaugcgauuagcgucaauugccuuuaaccauccaauccaaguagaccaacuaaauucuuccuauuucaaauuauccauaccaacaaauuucuccuuuggugucacccaggaauauauacaaacuacgauacagaaaguuacuguagacugcaaacaguauguaugcaacggauuucaaaaaugugaacaauuauugcgcgaauacggacaauucugcucgaaaauaaaccaagcacuucauggugcaaauuuaagacaagaugauucuguacgcaaucucuuugcaucgguaaagucuucacaaucuaguccuaucauaccaggauucggcggcgacuucaaucuaacucuacuagaacccguaucgaucucuacaggaucacgcucagcaagaucugcaaucgaagauuugcuuuuugacaaaguuacgauagcagaucccgguuacaugcagggauacgaugacugcaugcaacaaggaccagcaagcgcaagggaccuaauaugcgcacaauauguugcuggcuacaaaguccuaccaccauuaauggacguuaacauggaggcugcauauaccagcucucuacuugggucuauugcaggaguaggauggacugcaggacuuaguuccuuugcagcaaucccuuuugcacaaagcauauucuacagauuaaacggugucggaauaacccaacaaguccuuucugaaaaccagaaacuaauugcuaauaaauuuaaucaagcucuuggcgccaugcaaaccggcuucacaacaacuaacgaggcuuuucgaaagguacaagacgcagugaauaacaaugcacaagcccuauccaaguuggccagugaauugucuaauacuuuuggagcaauuagugcuucgauuggagauauuauccaacgauuagacguuuuagaacaagacgcucaaauagauagacuaauaaacggacgacucacaacuuuaaacgcauucguugcacaacagcuagugagaucugaauccgccgcacuauccgcacaauuagcaaaagauaaaguuaaugaauguguaaaagcacaaucaaaacgauccgguuuuugcggacaaggaacucauaucguaucuuuugugguaaacgcaccuaacggccuguauuuuaugcauguugguuauuacccgucuaaccacauagaaguuguauccgcauauggcuuaugcgacgcugcaaacccgacaaacuguaucgcaccaguaaauggauacuuuauaaaaaccaauaauacgcgaaucgucgaugaauggucauauacaggauccucauuuuaugcaccugaaccaaucacaucuuuaaacacuaaauauguagccccucaagucacauaucaaaauauuucuacaaaucucccaccuccucuccuaucaaauucaaccggaaucgacuuucaagaugaauuagaugaauuuuucaaaaacgucagcacuucuauaccuaauuuuggauccuuaacccaaauuaauacaacacuucucgaucucacauaugaaauguuaucacuacaacaaguagucaaggcuuuaaaugaaagcuauauagauuuaaaagaacuuggaaauuauacauauuacaauaaauggcccugguacaucugguuaggcuucauagccggucuuguugcucucgcucuaugcguauuuuucauauuauguuguacagguugcggaaccaacugcaugggcaaacuaaaauguaaccgaugcugugauagauaugaagaauaugaccuagaaccucacaaaguacauguacauuaa

SEQ ID NO: 1162 - RNA, 4062 nt, Artificial Sequence
  derived and/or modified CDS sequence (opt6) from MERS-CoV__ALA49803__S
augauacacucagucuuucuacuaauguucuuacucaccccaaccgaaaguuaugucgaugugggaccggacuccguaaaaucugccuguauugaaguagauauacaacagacauucuuugacaaaacuuggcccagaccaauagauguuucuaaagccgacggaauaauauacccccaaggccgaacguauucaaacauaacaauaaccuaucaaggucuauuuccuuaucaaggcgaccacggugaccguuacguauacuccgcuggccaugcaacaggaacuacaccacaaaaacuuuuuguagcaaacuauagucaagacguaaaacaguucgcaaauggauucgucguuagaaucggagccgcagcaaauuccaccggaaccguuauuauuaguccuuccaccucagcaaccauaagaaaaaucuacccugccuuuaugcucgggaguucggucggaaacuuuucagacggcaaaaugggacgcuuuuucaaucacacccuaguacucuuacccgauggaugcggaacuuuacuaagagcauucuauuguauccucgaacccagaaguggaaaccauugcccggcugguaacucauacacuuccuuugcaacguaccacacacccaguacggacugcucagaugguaauuauaaucgaaacgcaagccuaaauucauuuaaagaauacuuuaaucuacgaaauugcacuuuuauguacacauauaauauaacggaagacgaaauacuugaaugguucgguauaacacaaacagcucagggaguacaucuauucucgucgcgcuacguugauuuauauggaggaaauauguuucaauuugccacauuaccuguuuaugacacuaucaaauauuacucaauuauaccucacuccauacgcucuauacaauccgaccgaaaggcuugggcugcuuuuuauguuuacaaacuucaaccuuuaacauuuuuacuagacuucaguguagacgguuauauuagacgcgcaauugacugcggcuuuaaugaucuaucacagcuacacuguucguacgaaucuuuugacguagaaaguggaguauauucaguaucuuccuuugaagccaaaccaucagguucggucgucgaacaagcagaaggaguagagugugacuuuucaccacuucuuaguggcacuccaccccaaguauauaauuucaaaagauuaguuuuuaccaacuguaauuauaaccucacaaaacuacucucauuauuuucaguaaaugauuucacuuguucacaaaucagucccgcggcuaucgccagcaauugcuauaguucacuaauauuagacuauuuuucauauccacuuaguaugaaaucagaucuuucugugucaucagcaggaccaauuucacaauucaauuauaaacagucauucucaaacccaacauguuuaauuuuagcaacagucccucauaaucuaacaacaauaacuaaaccauuaaaauauaguuacauuaauaaaugcucaagacuuuuaagugacgaccgaacagagguuccacaauuaguaaacgcaaaccaauauucaccuuguguaucgauuguacccucgacuguaugggaagauggugacuauuauagaaaacagcucucaccacuagaagguggcggaugguuaguagcgaguggaucaacugucgcuaugacagaacaacuacaaaugggauuuggcauaacuguacaguacggaacggauacaaacucagucuguccaaaacucgaguuugcuaacgacaccaaaauagcaucacaauuaggaaauugcguagaauacucacuauauggcguaucaggaagaggggucuuucaaaacuguacagcaguaggaguacgacaacaaagauuugucuacgaugcauaucaaaacuuagugggauauuacuccgaugacgguaacuauuauuguuuaagggcuuguguaucagugccuguuucaguaaucuacgauaaagaaacuaaaacccacgccacucuguucggauccguugcaugugaacauauaucaucuacuaugucacaauauuccagaucgacuagaagcaugcuaaaaagacgagacucaacauauggaccccugcaaacuccuguaggcuguguauuaggucuaguaaauucaucauuguuuguugaggauuguaaacuuccccucgggcaaagucuaugugcauuaccugauacaccauccacucucacacccagaucaguaaggagcguacccggcgaaaugagauuggcaucgaucgcuuuuaaucacccaauacaaguagaccaauuaaauucguccuauuucaaauugagcauuccuacaaauuuuagcuucgguguaacucaggaauacauacaaacuacgauacaaaaaguaacaguagacuguaaacaauauguaugcaacggauuucaaaaaugcgaacaacugcuucgggaauauggacaauucuguuccaaaauuaaccaggcacuacauggcgcaaaccucagacaagaugauagugucagaaaucuauuugcaagcguaaaaucuucucaaucuucucccauaauuccaggauuuggaggugauuucaacuuaaccuuauuagaaccaguuucaaucaguacaggaucaagaucagcucguucagcuauagaagaucuguuguuugacaaaguaacaauagccgauccaggguacaugcaaggauacgacgacuguaugcaacagggaccugcaagugcaagggaccugauaugcgcucaauacgucgcuggcuauaaaguacuaccgccccuaauggauguaaauauggaagccgcguacacaaguucccuacuaggaagcauagcaggaguuggcuggacugcaggccuaaguucauucgcugccauaccauucgcacaaucuauauucuacagauuaaauggcguagguauaacacaacaaguacucagugaaaaucaaaaacugauagcaaacaaauucaaccaagcccucggugcaaugcaaacaggauuuacuacaacaaaugaggcuuucagaaaaguucaagacgcaguaaacaauaaugcgcaagcacucucaaaacuagccucagaacuaucaaacacuuucggugcuaucucagcguccauuggggacauaauccaaagauuagacguccuagaacaagacgcccaaauagauagguuaauaaacggaagacucacuaccuuaaaugcuuucguagcucaacagcuaguacguucagaaucugcagcccuuagugcacaacuggcgaaagacaaaguaaaugaaugugucaaagcacaaucaaaaagaucuggauuuuguggccaaggaacacauauugucucauuuguagugaacgcaccaaauggacucuauuuuaugcacguaggauauuacccaucgaaucauauugaaguggugucagcuuauggauugugcgaugcggcaaacccuacaaauugcaucgcaccugugaacggguauuucauaaaaacaaauaauacacgaguugucgaugaauggagcuauaccggaucaucuuucuaugccccagaaccaauaacaucucucaacacaaaauauguugcuccacaaguaacauaccaaaacauaaguaccaauuuaccaccuccucuuuuaucaaacuccacaggcauugauuuucaagaugaacuagacgaguucuuuaaaaauguaucuacuuccauuccaaauuucggaucacuaacccaaauuaauacaacacuauuagacuugacuuaugaaauguugucccuucaacaggucguaaaagcucuuaacgaaaguuacauagaccuuaaagaauuagguaauuacacauacuacaacaaauggccgugguacaucugguuagguuucauugcaggcuuaguugcgcuagcauuaugugucuuuuucauacuuuguuguacaggcugcgggacaaacuguaugggcaaacuaaaauguaaccgcugcugcgaccgauaugaagaauacgaccuagaaccucacaaaguacauguucacuaa

SEQ ID NO: 1163 - RNA, 4062 nt, Artificial Sequence
  derived and/or modified CDS sequence (opt6) from MERS-CoV__ALA49836__S
augauacauuccguuuuccuucucauguuucuucuuacucccacagaauccuauguagacguagguccagauuccguaaaauccgcuugcauagaaguggauauacaacaaacauucuucgacaaaacuuggcccagaccgaucgaugucucaaaggcugacggcaucauuuacccacaaggacgaacuuacucaaacauaacaauaacuuaucaagguuuguuuccauaccaaggcgaccacggugacauguauguauacucggcuggucacgcuacaggaacaacaccucaaaaacucuucgucgcaaauuauagucaagauguaaaacaauuugcaaacggauuuguaguuaggauaggcgcugcagcaaauucuacuggcaccguuaucauauccccaucuacaucagcaacaauccgaaaaauauaucccgcauuuauguuaggcucuagugucggcaacuuuucagauggaaaaaugggucgauucuucaaucauacccuaguauuauuacccgauggauguggaacacuacuacgcgcuuucuacuguauucuugaaccucgauccggaaaucauugccccgcgggcaacucauauacaucauuugcaacauaccauacuccugcaacagauugcucagacggcaacuacaaucgcaacgcaucccuaaacagcuuuaaagaauacuucaaccuacguaacuguacauuuauguauacauacaauauaacagaagacgaaauauuagaaugguuuggcauaacucaaacagcccagggcguacaucuauucucaaguagauauguugaccuuuauggaggaaauauguuccaauucgcuacauuaccaguuuacgacacaauuaaauacuauaguauaaucccacauaguauacgaucaauacaaucugauaggaaagcaugggcagcauucuacguauacaaauuacaaccauugacuuucuuacuagacuucaguguugacggcuauauucgcagagcuauagacugcgguuuuaaugaccuuucacaguuacacugcucuuaugaaucuuuugauguagaaucuggaguuuacuccguaucaucuuucgaagcaaaaccaucuggauccguugucgagcaagcagaaggaguagaaugcgauuucucaccacucuuaucuggaacaccuccccaaguuuauaacuucaaacgucucgucuuuacuaacuguaauuauaaccuaacaaaacuuuuaucacuauuuagcgucaacgacuucacauguucacaaauaucacccgccgcaaucgcuucuaauuguuauucaucauuaauacucgauuauuucaguuauccauuauccaugaaaucggacuuaucagucaguucugcuggaccaauuagucaauuuaacuauaaacaaucuaguucaaacccgacauguuuaauucuagcaacaguaccacauaauuuaacuacaauuacaaaaccucugaaauauagcuauauaaauaaauguucuagguuauuaucagacgaccgcacagaggucccucagcuagucaaugccaaccaauacucgccuugcguauccauaguuccuucaaccguaugggaagauggugauuauuaucgaaaacaacuaucacccuuagaaggaggugguuggcuuguagccucugguucaacuguugcaaugacugaacaacuucaaaugggcuucggaauaacaguucaauauggcacggacacaaacuccguaugucccaaauuagaauuugcgaaugauacaaaaauagccagccaauuaggaaauugugucgaauacucacuauauggugucucagguagaggcguauuucaaaacugcacagcaguggggguacgacaacaaagauuuguauaugacgcauaccaaaaucuaguaggauauuacucggaugacggcaauuacuacuguuuacgagccuguguuucaguacccgucagcguuauauacgauaaagaaaccaaaacacaugcaacacuauucggauccguggcaugcgaacacaucucgucuaccaugucacaauacucuagaucaacccgcucaaugcuaaaacgccgagacucaacuuaugguccuuuacaaacuccaguugguuguguccuaggccuagucaauucuagucucuucguagaagauuguaaauuaccacuaggucaaucacuaugcgcccuaccagauacuccaucuacuuuaacacccagauccguucgcuccguaccaggcgaaaugagacucgcaagcauagcauucaaccauccuauccagguagaccaacuuaacaguucauacuuuaaacuuucuauacccacgaauuucagcuuuggaguaacacaagaauacauccaaacaacaauacaaaaaguaacaguagacugcaaacaauacguauguaauggauuucaaaaaugugaacaauuauuaagagaauacggucaauuuuguucuaaaauaaaccaagcucuccauggagcaaaccuaagacaagaugacucaguuagaaauuuauuugccucaguaaaaucaucucaaucaucgccuaucauuccagguuucggcggugacuucaaucucacuuuauuagaaccaguaaguauaucaacagguaguaggucagcucgaucagcaauagaggauuuacucuucgauaagguaaccaucgcugaccccggguacaugcaggguuacgacgacuguaugcaacagggccccgcaucugcccgcgacuuaauuugcgcucaauauguagccggguauaaaguauuaccuccacuaauggacguaaacauggaagccgcauacacaucaucauuacucggcucuauugcuggaguaggauggacugcuggccuuucgucauuugcagcuauuccuuuugcacagucaauauucuacaggcuuaacggcguaggcauuacucaacaggucuuaucagaaaaucaaaaacuuauagcaaauaaauuuaaucaagcacuaggugcaaugcaaaccggauuuacaaccacaaaugaggcuuuuagaaaaguacaagacgccguaaauaacaacgcacaagcucuuuccaaacuagcaucugaauuaaguaauacauucggggcaauauccgccuccauaggagacaucauacaacgccuagacgucuuagaacaggacgcccaaauagauagacuaaucaauggcagacuaacaacucuaaaugccuucguggcacagcaacucguaagaucagaaucugccgcucuuucagcacaacuugccaaagauaaaguaaaugaauguguuaaggcacaauccaaacguaguggauuuuguggccaaggaacucauaucguaaguuucguuguaaaugcuccuaacggucuuuauuucaugcauguagguuacuauccaucuaaccacaucgaaguagucagcgcguauggauuaugugacgcggcgaauccuacaaacuguauugcccccguuaacgguuacuucauaaaaacaaacaacacacguauaguagacgaauggagcuauacagguucuagcuuuuaugcuccugaaccaauuacaagucuaaacacaaaauauguagcaccucaaguuacuuaccaaaacauaucaacaaaucuuccaccaccucuauuaggaaacucaaccggcauagauuuucaagaugaauuagacgaguucuuuaaaaacguaucuacaucaauuccaaacuucggaucuuuaacacaaauuaauacaaccuuacuagacuuaacuuacgaaauguuaucacuacaacaagucguaaaagcacuaaacgaaucauauauagaucuuaaagaauuaggaaauuauacauauuauaacaaauggccaugguacaucugguuagguuucaucgcugguuuagucgcgcuagcauuaugcguguucuuuauucuaugcuguacagguuguggaacuaauugcaugggaaaacuaaaaugcaauagauguugugaucguuaugaagaauaugaccuagaaccucauaaagugcacgugcauuaa

SEQ ID NO: 1164 - RNA, 4062 nt, Artificial Sequence
  derived and/or modified CDS sequence (opt6) from MERS-CoV__ALA49957__S
augauacacaguguuuuucuccuaauguuccuccuaacuccuacagaaucauaugucgacguaggaccugauucaguuaaaucagcaugcauagaaguugauauacaacaaacauucuuugacaaaaccuggccacgucccaucgacgucucaaaagcagauggaauuauauauccccaagguagaaccuauaguaauauaacuauaacauaucaaggccucuuuccauaccaaggcgaccauggugauauguauguguauuccgccggucaugcuacaggaacuacaccucaaaaacucuucguugcaaacuauucacaagauguuaaacaauucgcaaacggcuuuguugugagaauuggugcagccgcuaacucaacaggaacuguuauaaucucaccgucaacuucugcaacuauucgcaaaauauauccagcuuucaugcuaggaucaucaguugguaacuuuucugauggaaaaaugggccguuucuuuaaucauacacucguccuauuaccugauggaugugguacgcuacuaagagcauuuuacugcauauuagaaccccgaagugguaaccauugcccugcaggaaauucauacaccucuuuugcaacauaucacaccccugccacggauuguucagauggaaauuauaaccggaacgcaucauuaaauucauuuaaagaauauuucaauuuacguaacuguacauuuauguacacauacaauaucacagaagaugaaauacucgaaugguucggaauuacccaaacugcucaagguguccaccuauucucuucccgcuaugucgacuuauacggagguaauauguuccaauuugcaacacuaccugucuacgacacaauuaaauauuacaguauuauuccacacucuauccgaagcauccaaucugaucguaaggcuugggcagcauuuuacgucuauaaauuacaaccccuaacuuuucuucuagacuucaguguagauggcuauauacgcagagcuauagauuguggcuucaaugaccuuucacagcuucauugcucauaugaauccuuugacguagaauccggaguuuauuccguaucaucuuucgaagcaaaacccuccggaucaguaguugaacaagccgaaggcguugaaugugauuuuucaccacuacuuucagguacacccccucaaguuuacaacuuuaaacgauuaguuuucacaaauugcaacuauaaucuaacaaaacuauuaucccuauucaguguaaaugauuucacauguucucaaauaucaccagcagcuaucgcaagcaauugcuauucaucauuaauauuagauuauuucaguuauccacucuccaugaaaucagaucuaucaguaucaucagccgguccaauuucccaauucaacuauaaacaaucuuuuucaaauccuaccugucugauauuagcuacuguaccucauaaucuaacuacaauaacaaaaccauuaaaauacagcuacauaaacaaauguucuagacuacugagcgaugacagaacagaaguuccccagcuaguaaaugcgaaucaauauuccccaugugucaguaucguuccgucaacugucugggaagacggagacuacuacaggaaacaauuaagcccauuagaagguggagggugguuaguagcaucagguucaaccgucgcaaugacagaacaacuucaaauggguuucggaauuacaguacaauacgguacagauacuaacucaguuugucccaaacuugaauuugccaacgacacgaaaaucgcuucccaacuuggaaauugcguagaauacucuuuauauggaguaucaggaagagguguauuucagaacugcacagcaguggguguucgacaacaacgauuuguauaugacgcauaucaaaauuuaguaggauauuacucagaugauggaaacuauuauugucuuagggccugcguuucaguuccaguuucaguaauauacgacaaagaaacuaagacccacgcuacuuuauuugguucagucgcuugcgaacacauaucuaguacaaugucacaauauucacgaucaaccagaucuaugcuuaagcgaagggacucaacauauggaccgcugcaaaccccugucgguugcguacuaggacuuguaaauucgucauuauuuguagaggacuguaaauuaccucuaggucaaucucuuugcgcacuucccgacacacccucuacacugacccccagaaguguaagaucaguaccaggcgaaaugaggcuagcaaguauagcuuucaaucacccaauccaggucgaucaacucaauagcuccuauuuuaaauuauccauuccgacuaauuucucauucgguguaacucaagaauacauucaaacaacuauccaaaaaguaacaguagauugcaaacaauauguaugcaacggauuucaaaagugugaacaacuacuccgcgaauacggacaauuuuguagcaaaauuaaccaagcacuacacggagccaaucucaggcaagaugacucuguacgaaaccuauuugcaucuguuaaaagcucccaaucuucacccauaauacccggauucgguggagauuuuaauuuaacguuacuagaaccagucucaauaucaacaggaaguagaucagcccgauccgccaucgaagacuuauuauucgacaaaguuaccauagcagaccccgguuauaugcaaggcuacgaugauuguaugcaacaagguccagcuucagcuagggaccucauuugugcacaguauguagcaggauacaaaguuuuaccaccacuuauggaugucaauauggaggcagcuuauaccaguucgcuacuuggaagcauagcugguguugguuggaccgccggccuaucuagcuucgcugccauaccuuucgcccaaucuauauucuaccguuuaaaugguguuggaauuacucaacagguauuaagugaaaaccaaaaacuaaucgcaaacaaauucaaccaagcacuaggagcaaugcaaacuggauuuacaacaacgaacgaggcuuuucgcaaaguacaagaugcaguaaacaauaaugcacaggcacuaucaaaacuugcuucugaauuaucaaacacauuuggggccauaucugccuccauuggagacauuauacaaagguuagauguucuagaacaagacgcucagauugaccgucucauaaauggucgguuaacaacacuaaacgcuuucgucgcucaacagcuaguccguuccgaaucagcagcccuaagcgcacaacucgcaaaagauaaagucaacgaauguguuaaagcgcaaucuaaacgaaguggauucugcggacaaggaacucauauuguauccuuugucguaaaugcuccuaauggucuuuacuuuaugcacguuggauacuauccuucaaaccauauagaagucguuucggccuacggacuuugcgaugcagcgaacccaaccaauuguauugcuccaguaaacgguuacuuuauuaaaaccaauaauacaaccauugucgaugaauggucuuacacuggaucuuccuucuacgcuccugaacccauaaccucauuaaauacaaaauacguggcaccacaaguaacauaucaaaacaucucuacuaauuuaccuccaccuuuacuagguaacucaacaggaauagauuuucaagacgaacuugaugaguucuuuaaaaacguuucaacuucuauucccaacuucgguagucuaacccaaauaaauacaacauugcuagaccuaacuuacgaaaugcuaucauuacaacaaguuguuaaagcacuuaaugaaucuuauauugauuuaaaagaacuaggcaacuauacauauuauaacaaauggccuugguacaucuggcuuggguuuauagccggauuaguagcuuuagcacucuguguauuuuucauccuauguugcacaggcugcggcacaaacuguauggggaaacugaaauguaacagauguugugauagauaugaagaauaugaccucgaaccacauaaaguacauguucauuaa

SEQ ID NO: 1165 - RNA, 4062 nt, Artificial Sequence
  derived and/or modified CDS sequence (opt6) from MERS-CoV__ALA50067__S
augauccauucgguauuucucuugauguuucuuuuaaccccgaccgaauccuacguagacgucggcccagauuccguaaaaucagcuugcauagaaguagauauccaacaaacauucuuugacaagacuuggccaaggcccauugacguaucuaaagcagaugguauuaucuacccucaaggaagaacauauuccaauauaacaauaacauaccagggccuauuuccauaucaaggugaccauggcgacauguacgucuauucagcaggucacgcuacugguacaacaccacaaaaacuauuugucgcaaacuauucacaagacguuaaacaauuugcuaauggauucguagugcgcauaggugcugcagccaauuccacaggaacaguuauuauaaguccuucaacaucagcaacaauucgcaaaauuuauccugccuuuaugcuuggaagcucaguaggcaauuuuucugauggcaagauggguagauucuuuaaccacacuuuaguacuucuaccggacggauguggcacucuacuucgcgccuuuuauugcauucuagaaccaagaucaggaaaucauuguccugccggaaacaguuacacuuccuucgcaacguaccauacaccagcaacagauuguucugauggcaauuacaauagaaacgcauccuuaaacucauuuaaagaauauuuuaauuuacgaaacuguaccuucauguauacuuauaauauuacagaagacgaaauacuugaaugguuugguauaacgcaaacugcacaaggaguucauuuguuuagcucacgauacguagaccucuauggaggcaacauguuucaauuugccacucugccuguauacgauaccaucaaauauuauucuauaaucccccacuccauucgcucaauacaaucagauagaaaggcuugggcugcguuuuauguuuauaaacuucaaccgcuuaccuuuuuauuagacuucagcguagauggcuauauacgacgggcuaucgauuguggauuuaacgauuuaucacaacuccauugcucauaugaaucuuucgacguagaaucuggaguuuacucuguuaguucuuuugaagcgaaaccaucugguuccguaguagaacaagcugaaggaguagaaugugauuucagcccccuacuuucaggcacucccccacaaguauacaauuucaagcgauuagucuuuaccaacugcaauuacaauuuaacaaaauugcuaucccuauuuucaguuaaugacuuuaccuguucacaaauaucuccugccgcuauagcaucaaacugcuauucuucauuaauuuuagauuauuuuucauauccacuauccaugaaauccgaucuuucuguaucgucaucaggcccaauaucacaauucaauuauaaacaaucauuuucaaacccuacuugcuuaauacuugcaaccguaccccauaaucuuaccacuauuacuaaaccuuuaaaauauaguuacauaaauaaaugcucaagguuauuaucugaugauagaaccgaaguuccccagcuugucaaugcuaaucaauacuccccaugcguaucaaucguccccucaacaguaugggaagacggagauuauuacagaaaacaauuaucuccauuagaagguggaggauggcucguggcaucagguucgaccguugccaugacugaacaauuacaaauggguuuugggaucacuguacaauacggaacagauacuaacucuguauguccuaaacuagaauuugcaaaugauacaaaaauagccagucaauuagguaacugcgucgaauacuccuuauaugggguaucugggaggggcguuuuucaaaauugcacagcaguagguguucgccaacagagauuuguguacgaugcuuaucaaaauuuaguaggguacuacucugacgacggaaauuacuauugccuacgagccugugugagcguuccugucuccguaauauacgacaaagaaacaaaaacucaugcuacauuauucggcucuguagcuugcgaacacaucucuaguaccaugucgcaauacucuagaucaacacguaguaugcuuaaacgaagggauucaacauacggcccauuacaaacaccaguaggauguguacucggucucgucaauucuucccuuuuuguggaagauuguaaacucccauugggccagucucucugcgcccuuccugauacuccaaguacuuuaacaccacguaguguccgcucaguuccaggagaaaugagacuugcuucaauugccuuuaaccaccccauacaagucgaucaauuaaacuccucauacuuuaaacuuucaauaccaacaaauuucucuuucggaguuacacaagaauauauacaaacaacaauacaaaaaguuacuguagauuguaaacaauauguauguaauggauuccaaaaaugugaacaacuauuaagagaauauggacaguuuugcuccaaaauuaaucaggcuuuacauggcgcaaaccuccgacaagacgacucuguaaggaauuuauucgcuuccguuaaaucaucccaaagcucuccaauaauaccaggauucgguggagauuucaacuugacucuacuagaaccuguaucgauaagcacuggaagcagaucggcccgcuccgcuauugaagaucuucuauucgacaaaguuacaauagcugacccagguuacaugcaaggauacgaugacuguaugcaacaaggacccgccucagcccgagacuuaaucugugcacaauauguugcuggcuauaaagucuuaccaccacuaauggacgucaauauggaagcagcauauacaucaagucuacucggaucuauagcaggaguagguuggacugcgggccuaaguagcuuugcggcaauaccuuucgcacagucaauauuuuauagacucaacggaguagggauaacacaacaagugcuaucagaaaaucaaaaacuaauagcaaauaaguucaaccaagcauuaggggcaaugcaaacaggauucacuacaacaaaugaagcauuccguaaaguacaagaugcgguuaauaacaacgcucaagcccucucaaagcuagcaagcgaacuaagcaauacuuucggcgcaauaucagcaucaaucggagacauaauacaaagauuagacguuuuagaacaagaugcucaaauagacagacuaauaaauggucgcuugaccacacuaaaugcauucguagcacaacaacuuguuagaagugaaucugccgcauuauccgcacagcucgcaaaagacaaaguuaacgaaugcguaaaagcccaaagcaaaagaucagguuucugcggucaaggaacccacauuguaucauuuguagucaacgcuccuaauggucuuuauuucaugcauguaggcuauuaucccaguaaccacauugaaguaguaucagccuaugggcuaugugaugcagcuaacccuacaaacugcauugcuccuguaaauggcuauuucaucaaaacuaacaauacacguaucguagaugaauggucauacacaggcucaaguuuuuaugcgcccgaaccgauuacuucuuuaaauacuaaauauguugcaccacaagucacauaucaaaauauaucaacuaaucucccuccaccucuacuaucuaacucgacuggaauagauuuccaagacgaacuagaugaauuuuucaaaaaugucaguacauccaucccuaacuucggaucauuaacucaaauaaauacaacauuacucgauuuaaccuacgaaaugcuaucauuacaacaaguuguaaaagcucucaacgaaaguuacauagauuugaaagaacuaggaaacuacacauacuauaacaaauggccaugguacauauggcucggauuuauagcaggacuuguugcuuuagcacuaugugucuucuuuauacuaugcugcacagggugcggcacuaacugcauggggaaacucaaauguaauagauguugugaucgauaugaagaauaugaucucgaaccacauaaaguacacguacacuaa

SEQ ID NO: 1166 - RNA, 249 nt, Artificial Sequence
  derived and/or modified CDS sequence (opt6) from MERS-CoV__AGH58723__E
augcuaccauucguacaagaaagaauaggacuauucauaguaaacuucuucauauucacaguaguaugcgcaauaacacuacuaguaugcauggcauuccuaacagcaacaagacuaugcguacaaugcaugacaggauucaacacacuacuaguacaaccagcacuauaccuauacaacacaggaagaucaguauacguaaaauuccaagacucaaaaccaccacuaccaccagacgaauggguauaa

SEQ ID NO: 1167 - RNA, 249 nt, Artificial Sequence
  derived and/or modified CDS sequence (opt6) from MERS-CoV__AGV08472__E
augcuaccauucguacaagaaagaguaggacuauucauaguaaacuucuucauauucacaguaguaugcgcaauaacacuacuaguaugcauggcauuccuaacagcaacaagacuaugcguacaaugcaugacaggauucaacacacuacuaguacaaccagcacuauaccuauacaacacaggaagaucaguauacguaaaauuccaagacucaaaaccaccacuaccaccagacgaauggguauaa

SEQ ID NO: 1168 - RNA, 249 nt, Artificial Sequence
  derived and/or modified CDS sequence (opt6) from MERS-CoV__AGV08540__E
augcuaccauucguacaagaaagaauaggacuauucauaguaaaauucuucauauucacaguaguaugcgcaauaacacuacuaguaugcauggcauuccuaacagcaacaagacuaugcguacaaugcaugacaggauucaacacacuacuaguacaaccagcacuauaccuauacaacacaggaagaucaguauacguaaaauuccaagacucaaaaccaccacuaccaccagacgaauggguauaa

SEQ ID NO: 1169 - RNA, 249 nt, Artificial Sequence
  derived and/or modified CDS sequence (opt6) from MERS-CoV__ALX27237__E
augcuaccauucguacaagaaagaauaggacuauucauaguaaacuucuucauauucacaguaguaugcgcaauaacacuacuaguaugcauggcauuccuaacagcaacaagacuaugcguacaaugcaugacaggauucaacacacuacuaguacaaccagcacuauaccuauacaacacaggaagaucaguauacguaaaauuccaagacucaaaaccaccacuaccaucagacgaauggguauaa

SEQ ID NO: 1170 - RNA, 249 nt, Artificial Sequence
  derived and/or modified CDS sequence (opt6) from MERS-CoV__ALR69646__E
augcuaccauucguacaagaaagaauaggacuauucauaguaaacuucuucauauucacaguaguaugcgcaauaacacuacuaguaugcauggcauuccuaacagcaacaagacuaugcguacaaugcauaacaggauucaacacacuacuaguacaaccagcacuauaccuauacaacacaggaagaucaguauacguaaaauuccaagacucaaaaccaccacuaccaccagacgaauggguauaa

SEQ ID NO: 1171 - RNA, 249 nt, Artificial Sequence
  derived and/or modified CDS sequence (opt6) from MERS-CoV__ALA49346__E
augcuaccauucguacaagaaagaauaggacuauucauaguaaacuucucaauauucacaguaguaugcgcaauaacacuacuaguaugcauggcauuccuaacagcaacaagacuaugcguacaaugcaugacaggauucaacacacuacuaguacaaccagcacuauaccuauacaacacaggaagaucaguauacguaaaauuccaagacucaaaaccaccacuaccaccagacgaauggguauaa

SEQ ID NO: 1172 - RNA, 249 nt, Artificial Sequence
  derived and/or modified CDS sequence (opt6) from MERS-CoV__ALA49390__E
augcuaccauucguacaagaaagaauaggacuauucauaguaaacuucuucauauucacaguaguaugcgcaauaacacuacuaguaugcauggcauuccuaacagcaacaagacuaugcguacaaugcaugacaggacuaaacacacuacuaguacaaccagcacuauaccuauacaacacaggaagaucaguauacguaaaauuccaagacucaaaaccaccauuaccaccagacgaauggguauaa

SEQ ID NO: 1173 - RNA, 660 nt, Artificial Sequence
  derived and/or modified CDS sequence (opt6) from MERS-CoV__AFS88942__M
augagcaacaugacacaauuaacagaagcccaaauaauagccauaauaaaagacuggaacuucgcauggucauuaauauuucuacuaauaacaauaguacuacaauacgguuacccaagcagaucaaugacaguauacguuuucaaaauguucguauuaugguuacuauggccaucaaguauggcauuaagcauauucucagcaguauacccaauagaucuagcaucacaaaucauaagcggaauaguugcagcagucucagccaugauguggauaucauacuuuguacaaagcauaagauuauucaugagaacaggaucuugguggagcuuuaacccagaaacaaacuguuuacuaaacguaccauuuggcggaacaacaguaguaagaccauuaguagaagauaguacaaguguaacagcaguaguaacaaauggacaucuaaaaauggcaggaaugcacuucggagcaugcgauuacgauagauuaccaaaugaaguaacaguagcaaaaccaaauguauuaauagcacuaaaaaugguaaaaagacaaucauacggaacaaauucaggaguagcaauauaucacagauacaaagccggaaacuauagaucaccaccaauaacagcagauauagaacuagcacuauuaagagcauaa

SEQ ID NO: 1174 - RNA, 660 nt, Artificial Sequence
  derived and/or modified CDS sequence (opt6) from MERS-CoV__AGH58718__M
augucaaauaugacacaauuaacagaagcacaaauaauagcaguuauaaaagacuggaacuuugcauggucauuaauauuuuuacuaauaacuauaguauuacaauacggauacccauccagaucaaugacaguauacguauucaaaauguuuguauuaugguuacuauggccaucaucaauggcauuaagcauauucucaacaguauacccaaucgauuuagcuucacaaauaauaucaggaauaguagcagcaguaucagcaaugauguggauaucauacuuuguacaauccauuagauuauucaugagaacaggaucaugguggucauuuaacccagaaacaaauugucuacuaaacguaccauuuggaggaacaacagucguaagaccauuaguagaagauuccacaucaguaacagcaguaguaacaaauggacaucuaaaaauggcaggaaugcacuuuggagcaugcgauuacgauagauuaccaaaugaaguaacaguagcaaaaccaaacguauuaauagcacuaaaaaugguaaaacgacaaucauacggaacaaauucuggaguagcaauauaucacagauacaaagcaggaaacuauagaucuccucccauaacagcagacaucgaacuagcacuauuaagagcauaa

SEQ ID NO: 1175 - RNA, 660 nt, Artificial Sequence
  derived and/or modified CDS sequence (opt6) from MERS-CoV__AGV08396__M
augucaaacaugacacaauuaacagaagcacaaauaauagcaauaauaaaagacuggaacuucgccuggucacuaauauucuuacuaauaacaauaguacuacaauacggauauccaucaagaucaaugacaguauacguauucaaaauguuuguacuauggcuacuauggccaucaucaauggcacuaucaauauucucagcaauauacccaauagacuuagcaagccaaauaauaucaggaauaguagcagcaguaucagcaaugauguggauaucauacuucguacaaucaauaagacuauucaugagaacaggaucauggugguccuucaacccagaaacaaacugcuuauuaaacguaccauuuggcggaacaacagucguaagaccauuaguagaagacuccacaucaguaacagcaguaguaacaaacggacaucuaaaaauggcaggaaugcacuucggagcaugcgacuacgacagauuaccuaacgaaguaacaguagcaaaaccaaacguauuaauagcacuaaaaaugguaaaaagacaaucauauggaacaaacucaggaguagcaaucuaccacagauauaaagcaggaaacuacagaucaccaccaauaacagcagacauagaauuagcacuacuaagagcauaa

SEQ ID NO: 1176 - RNA, 660 nt, Artificial Sequence
  derived and/or modified CDS sequence (opt6) from MERS-CoV__AGV08590__M
augucaaacaugacacaauuaacagaagcccaaauaauagcaauaauaaaagacuggaacuuuguauggucacuaaucuuccuauuaauaacaauaguacuacaauacggauacccaagcagaucaaugacaguauacguauucaaaauguucguacuaugguuacucuggccaucaucaauggcacuaucaauauucucagcaguauacccaauagacuuagcaucacaaauaauaucaggaauaguagcagcaguaucagcaaugauguggauaucauacuucguacaaucaauaagauuauucaugcgaacaggaucaugguggucauucaacccagaaacaaacugccuauuaaacguaccauucggaggaacaacaguaguacgaccccuaguagaagauucaacaucaguaacagcagucguaacaaacggacaccuaaaaauggcaggcaugcacuuuggagcaugcgauuacgacagacuaccaaaugaaguaacuguagcaaaaccaaauguauuaauagcauuaaaaaugguaaaaagacaaucauacggaacaaacucaggagucgcaauauaccacagauacaaagcaggaaacuacagaucaccaccaauaacagcagauaucgaacuagcacuccuaagagcauaa

SEQ ID NO: 1177 - RNA, 660 nt, Artificial Sequence
  derived and/or modified CDS sequence (opt6) from MERS-CoV__AHI48567__M
augagcaauaugacacaauuagcagaagcacaaauaauagcaauaauaaaagacuggaacuuugcauggucauuaauauuccuauuaauaacaauaguacuacaauauggauacccaucaagauccaugacaguauacguauuuaaaauguuuguacuauggcuauuauggccaucaucaauggcauuaucaauauucucagcaguauacccaauagacuuagcaucacaaauaauaagcggaauagucgcagcaguaucagcaaugauguggauaucauacuuuguacaaucaauaagacuauucaugagaacuggaucaugguggucauuuaacccagaaacaaacugucuauuaaacguaccauucggaggaacaacaguaguaagacccuuaguagaagauagcacaucaguaacagcaguaguaacaaauggacaucuaaaaauggcaggaaugcacuuuggagcaugcgauuacgacagacuacccaaugaaguaaccguagcaaaaccaaauguauuaauagcauuaaaaaugguaaaaagacaaucauacggaacaaauucaggaguagcaauauaucacagauauaaagcaggaaacuacagaucacccccaauaacagcagauauagaacuagcauuacuacgagcauaa

SEQ ID NO: 1178 - RNA, 660 nt, Artificial Sequence
  derived and/or modified CDS sequence (opt6) from MERS-CoV__AHI48589__M
augucaaauaugacacaacuaacagaagcacaaauaauagcaguaauaaaagauuggaacuuugcauggaguuuaauauuucuauuaauaacaauaguacuacaauacggauacccaucaagaucaaugacaguauauguauucaaaauguuuguauuaugguuauuauggccaucaucaauggcauuaucaauauucucagcaauauacccaauagaucuagcaucccaaauaauaagcggaauaguagcagcaguaucagcaaugauguggauaucauacuuuguacaaagcauacgacuauucaugcgaacaggaucaugguggagcuuuaacccagaaacaaacugucuacuaaacgucccauuuggaggaaccacaguaguaagaccucuaguagaagauagcacuucaguaacagcaguaguuacaaauggacaucucaaaauggcaggaaugcacuuuggagcaugcgauuacgauagacuaccaaaugaaguaacaguagcaaaaccaaauguauuaauagcauuaaaaaugguaaaacgacaaucauacggaacaaauucaggaguagcaauauaucacagauacaaagccggaaacuauagaucaccaccaaucacagcagacauagaacuagcacuauuaagagcauaa

SEQ ID NO: 1179 - RNA, 660 nt, Artificial Sequence
  derived and/or modified CDS sequence (opt6) from MERS-CoV__AIL23940__M
augucaaacaugacacaauuaaccgaagcacaaauaauagcaauaauaaaagacuggaacuuugcauggucauuaauauuccuacuaauaacaauaguacuacaauacggauacccaucaagaagcaugacaguauacguauucaaaauguuuguacuauggcuacuauggccaucaagcauggcacuaucaauauucucagccauauacccaauagacuuagcaucacaaauaauaucaggaauaguagcagcaguaucagcaaugauguggauaucauacuucguacaaucaauaagacuauucaugcgaacagguucaugguggucauucaacccagaaacaaacugucuacuaaacguaccauucggaggaacaaccguaguaagaccccuaguagaagacucaacaucaguaacagcaguaguaacaaacggccacuuaaaaauggcaggaaugcacuuuggcgccugcgacuacgauagacuaccaaaugaaguaacaguagcaaaaccaaauguaguaauagcacuaaaaaugguaaaaagacaaucauauggaacaaacucuggaguagcaauauaccacagauacaaagccggaaacuacagaucaccaccaauaacagcagacauagaacuagcacuacuaagagcauaa

SEQ ID NO: 1180 - RNA, 660 nt, Artificial Sequence
  derived and/or modified CDS sequence (opt6) from MERS-CoV__AKM76245__M
augucaaacauaacacaacuaacagaagcacaaauaauagcaauaaucaaagauuggaacuuugcauggucauuaauauuuuuauuaauaacaauaguacuacaauacggauacccaucaagaucaaugacaguuuacguauucaaaauguuuguauuauggcuacuauggccaucaucaauggcauuaucaauauucucagcaguauacccaauagaucuagcaucucaaauaauaagcgguauaguagcagcaguaucagcaaugauguggauaucauacuuuguccaaucaauaagacuauucaugagaacaggaucaugguggucauucaacccugaaacaaacugucuacuaaacguaccauucggaggaacaacaguaguacgaccauuaguagaagacuccacaucaguaaccgcaguaguaaccaauggacaccuaaaaauggcaggaaugcacuuuggagcaugcgauuacgacagauuaccaaaugaaguaacaguagccaaaccaaauguauuaauagcacuaaaaaugguaaaaagacaaucauacggaacaaauucaggaguagcaauauaucacagauacaaagcaggaaauuauagauccccaccaauaacagcagacauagaacuagcauuacuaagagcauaa

SEQ ID NO: 1181 - RNA, 660 nt, Artificial Sequence
  derived and/or modified CDS sequence (opt6) from MERS-CoV__ALW82726__M
augucaaacaugacacaauuaacagaagcccaaauaauagcaauaauaaaagacuggcacuuugcauggucacuaauauuccuauuaauaacaauaguauuacaauacggauacccaucaagauccaugacaguauacguauuuaaaauguucguacuaugguuacuauggccaucauccauggcacuaucaauauucucagcaauauacccaauagacuuagcaucacaaauaauaucaggaauaguagcagcaguaucagcaaugauguggauaucauacuucguacaaucaauaagacuauucaugagaacaggaucaugguggagcuucaaccccgaaacaaacugccuauuaaacguaccaauaggaggaacaacaguaguaagaccauuaguagaagacucaacaucaguaacagcaguaguaacaaacggacaucuaaaaauggcaggaaugcacuucggagcaugcgacuacgacagacuaccaaacgaaguaacaguagcaaaaccaaacguacuaauagcacuaaaaaugguaaaaagacaaucauauggaaccaacucaggaguagcaauauaccacagauacaaagcaggaaacuauagauccccaccaaucacagcagauauagaacuagcacuacuacgagccuaa

SEQ ID NO: 1182 - RNA, 660 nt, Artificial Sequence
  derived and/or modified CDS sequence (opt6) from MERS-CoV__ALX27238__M
augucaaauaugacacaauuaacagaagcacaaauaauagcaauaauaaaagacuggucauuugcauggucauuaauauuuuuauuaaucacaauaguacuacaauacggauauccaagcagaucaaugacaguauacguauucaaaauguuuguauuaugguuacuauggccaucaagcauggcauuaucaauauucucagcaguauauccaauagaucuagcaucacaaauaauaucaggaauaguagcagcaguaucugcaaugauguggauaucauacuuuguacaaucaauaagauuauucaugagaacuggaucaugguggagcuuuaacccagaaacaaacugucuauuaaacguuccauuuggaggaacaacaguaguaagaccauuaguagaagauucaacaucaguaacagcagucguuacaaauggacaucuaaaaauggcaggaaugcacuuuggagcaugugauuacgauagauuaccaaaugaaguuacaguagcaaaaccaaauguacuaauagcacuaaaaaugguaaaaagacaaucauacggaacaaauagcggaguagcaauauaccacagauacaaagcaggaaacuauagaucaccaccaauaacagcagauauugaauuagcacuauuaagagcauaa

SEQ ID NO: 1183 - RNA, 660 nt, Artificial Sequence
  derived and/or modified CDS sequence (opt6) from MERS-CoV__AMQ49021__M
augucaaacaugacacaauuaacagaagcacaaauaauagcaauaauaaaagacuggcacuucgcauggucauuaauauucuuacuaauaacaauaguacuacaauacggauacccaucaagaucaaugaccguauacguauucaaaauguucguucuaugguuacuauggccaucaucaauggcacuaucaauauucucagcaauauacccaauagaccuagcaucacaaauaauaucaggaauaguagcagcaguaucagcaaugauguggauaucauacuucguacaaucaaucagacuauucaugcgaacaggaucaugguggucauuuaacccagaaacaaacugccuacuaaacguaccaauaggaggaacaacaguaguacgaccccuaguagaagacucaacaucaguaacagcaguaguaacaaacggacaccuaaaaauggcaggcaugcacuucggagcaugcgacuacgacagauuaucaaacgaaguaacaguagcaaaaccaaacguauuaauagcacuaaaaaugguaaaaagacaaucauacggaaccaacagcggaguagcaauauaccacagauacaaagcaggaaacuacagaucaccaccaauuacagccgacauugaacuagcacuacuacgagcauaa

SEQ ID NO: 1184 - RNA, 660 nt, Artificial Sequence
  derived and/or modified CDS sequence (opt6) from MERS-CoV__AJG44108__M
augucaaauaugacacaacuaacagaagcacaaauaauagcaauaauaaaagacuggaacuuugcauggucauuaauauuucuauuaauaacaauaguacuacaauacggauacccaucaagaucaaugacaguauacguauucaaaauguuuguauuaugguuacuauggccaucuucaauggcauuaagcauauucucagcauuuuacccaauagaucuagcaucacaaauaauaucaggaauaguagcagcaguaucagcaaugauguggauaucauauuuuguacaaucaauaagacuauucaugcgaacaggaucaugguggucauucaacccagaaacaaauugucuauuaaacguaccauuuggaggaaccacuguaguaagaccauuaguagaagauucaacuucaguaacagcaguaguuacaaauggacaucuaaaaauggcaggaaugcacuuuggagcaugcgauuacgauagacuaccaaaugaaguaacaguagcaaaaccaaauguauuaauagcacuaaaaaugguaaaaagacaauccuacggaacaaauucaggaguagcaauauaccacagauauaaagccggaaacuauagaucuccaccaauaacagcagauauagaacuagcucuauuacgagcauaa

SEQ ID NO: 1185 - RNA, 660 nt, Artificial Sequence
  derived and/or modified CDS sequence (opt6) from MERS-CoV__ALA49369__M
augucaaacaugacacaacuaacagaagcacaaauaauagcaauaauaaaagacuggaacuucgcauggucacuaauauuccuauuaauaacaauaguacuacaauacggauacccaucaagauccaugacaguauacguauucaaaauguucguacuauggcuacuauggccaucauccauggcacuaucuauauucucagccauauacccaauagaccuagcaucccaaauaauaucaggaauaguagcagcaguaucagcaaugauguggauaucauacuucguacaaucaauacgacuauucaugcgaacaggaucaugguggucauucaacccagaaacaaacugccuacuaaacguaccaauaggaggaacaacaguaguaagaccccuaguagaagacucaacaucaguaacagcaguaguaacuaacggacaucuaaaaauggcaggaaugcacuucggagcaugcgacuacgacagacuaccaaacgaagucaccguagcaaaaccaaauguacuaauagcacuaaaaauggucaaaagacaauccuacggaacaaacucaggaguagcaauauaccacagauacaaagcaggaaacuauagaucaccaccaauuacagcagacauagaacuagcacuacuaagagcauaa

SEQ ID NO: 1186 - RNA, 660 nt, Artificial Sequence
  derived and/or modified CDS sequence (opt6) from MERS-CoV__ALA49424__M
augucaaacaugacacaacuaacagaagcacaaaucauagccauaauaaaagacuggaacuucgcauggucucuaauauucuuacuaauaacaauaguauuacaauacggauacccaucaagaaguaugacaguauacguauucaaaauguucguauuauggcuauuauggccaucaucaauggcacuaucaauauucucagcaauauacccaauagaccuagcaucacaaaucauuucaggaauaguagcagcaguaucugcaaugaugagaauaucauacuucguacaaagcauaagacuauucaugagaacaggaucaugguggucauuuaacccagaaacaaacugucuacuaaacguaccauucggaggaacaacaguaguaagaccacucguagaagacuccacaagcguaacagcaguaguaacuaacggacaccuaaaaauggcaggaaugcacuucggagcaugcgauuacgacagauuaccaaacgaaguaacaguagccaaaccaaacguuuuaauagcauuaaaaaugguaaaaagacaauccuacggaacaaacucaggaguagcaauauaccacagauacaaagcaggaaacuacagaucaccaccaauaacagcagacauagaacuagcacuauuaagagcauaa

SEQ ID NO: 1187 - RNA, 660 nt, Artificial Sequence
  derived and/or modified CDS sequence (opt6) from MERS-CoV__ALA49908__M
augucaaacaugacacaauuaacagaagcacaaauaauagcaauaaucaaagacuggaauuuugcauggucacuaauauuccuacuaauaacaauaguacuacaauacggauacccaucaagaagcaugacaguauacguauucaaaauguucguauuauggcuacuauggccaucaucaauggcacuaagcauauucucagcaauauacccaauagaucucucaucacaaauaauaucaggaauaguagcagcaguaucagcaaugauguggauaucauacuucguacaaagcauacgacuauucaugcgaacaggaucaugguggucauucaauccagaaaccaacugccuccuaaacguaccauucggaggaacaacaguaguaagaccccuaguagaagauucaacaucaguaacagcaguaguaacaaacggccaucuaaaaauggcaggaaugcacuucggagcaugcgacuacgacagacuaccaaacgaagucaccguagcaaaaccaaacguacuaauagcacuaaaaaugguaaaaagacaaucauacggaacaaacucaggaguagcaauauaccacagauacaaagccggaaauuacagaucaccaccaauaacagcagacauagaauuagcacuacuaagagcauaa

SEQ ID NO: 1188 - RNA, 660 nt, Artificial Sequence
  derived and/or modified CDS sequence (opt6) from MERS-CoV__ALA49963__M
augagcaacaugacacaauuaacagaagcccaaauaauagcaauaauaaaagacuggaacuucgcauggucacuaauauucuuacuaauaacaauaguauuacaauacggauacccaucaagaagcaugacaguauacguauuuaaaauguucguacuauggcuauuauggccauccuccauggcacuaucaauauucucagcaauauacccaauagauuuagcaucccaaauaauaucaggaauaguagcagcaguaucugcaaugauguggauaucauacuucguacaaagcauaagauuauucaugagaacaggaucaugguggucauucaacccagaaacuaacugccuauuaaacguaccaauaggaggaacaacaguaguaagaccacuugucgaagauucaacaucaguaacagcaguaguaacaaacggacacuuaaaaauggcaggcaugcacuucggagcaugcgacuaugacagacuaucaaaugaaguaaccguagcaaaaccaaacguauuaauagcacuaaaaaugguaaaaagacaaucauacggaacaaacuccggagucgcaauauaccacagauauaaagcaggaaacuacagaucaccaccaaucacagcagauauagaacuagcauuacuaagagcauaa

SEQ ID NO: 1189 - RNA, 1242 nt, Artificial Sequence
  derived and/or modified CDS sequence (opt6) from MERS-CoV__AFS88943__N
auggcaucaccagcagcuccaagagcaguaucuuucgcagacaauaacgacauaacaaauacaaacuuaagucgaggacguggaagaaacccaaaaccaagagcagcacccaauaauaccguaucaugguacacaggacuaacacaacacgguaaagucccauuaacauucccaccaggccaaggaguaccauuaaacgcaaacucaaccccagcacaaaaugcuggauacuggagaagacaagaucgaaaaauaaauaccggaaacggaauaaaacaauuagcacccagaugguauuuuuauuauacaggaacaggaccagaagcagcacuaccuuucagagcuguaaaagacggaauaguauggguacacgaagacggagccaccgacgcacccuccacuuucgguacaagaaauccuaacaacgauagugcaauaguaacacaauuugcaccuggaacaaaacuaccaaaaaacuuccauauagaaggaacaggaggaaacucacaaucaucaucccgagcaaguagccuaucaagaaacucaucaagaucauccucacaaggaucccgaagcggaaacucaacaagaggaacuaguccaggaccaaguggaauaggagcaguaggaggagacuuacuauauuuagaccuauuaaacagacuacaagcacuagaaucugggaaaguaaaacaaucacaaccaaaaguaauaacaaaaaaagaugcagcugcagcaaaaaacaaaaugagacacaaaagaacaucaacuaaauccuucaauaugguacaggcauucggauuaagaggaccaggagaucuacaaggaaacuucggcgacuuacaacuuaacaaacuaggaacagaagacccacgauggccacaaaucgcagaacuagcaccaacugcaagugcauuuaugggaaugagucaauuuaaguuaacacaucaaaacaaugaugaucacggaaacccagucuauuuccucagauacucaggagcaauaaaacucgacccaaaaaacccaaauuauaauaaaugguuagaacuauuagaacaaaauauugacgcauacaaaacauuuccaaaaaaagaaaaaaaacaaaaagcaccaaaagaagaaucaacagaucaaaugagcgaaccacccaaagaacaaagaguccaaggaagcauaacacaaagaacaagaacacgaccaucaguacaaccaggacccaugauagacguuaacacagacuaa

SEQ ID NO: 1190 - RNA, 1236 nt, Artificial Sequence
  derived and/or modified CDS sequence (opt6) from MERS-CoV__AFY13314__N
auggcaucacccgcagccccacgugcaguaucauuugcagauaauaaugacaucacaaacacaaacuuaucaagaggaagaggacgaaacccaaaaccaagagcagcaccaaauaacacaguauccugguauacgggacuaacucaacacggaaaagugccacuaacauucccacccggacaaggagucccacuaaaugcaaacucgacaccagcacaaaacgcaggauauuggagaagacaagacagaaaaauaaauacaggaaacggaauuaaacaauuagcacccagaugguauuuuuauuacacagguacaggaccagaagcagcucuaccauuuagagcaguaaaagauggcaucguauggguacacgaagauggagcaacagacgcaccaucaacauucgguacuagaaacccuaauaacgacagcgcaauaguaacucaauuugcaccaggaaccaaacucccaaaaaacuuucacauagaaggaacaggcggaaauucccaaucuucaucacgagcaucaucagucucaagaaacaguucaagaucaucaucacaaggaucuagaucagguaacagcacaagaggaaccagcccaggaccaucuggaauaggagccguaggaggagaccuacuauaccuagaccucuuaaacagacuucaagcauuagaaucaggaaaagucaaacaaagccaacccaagguaauaacaaaaaaggacgcugcagcagcaaaaaacaaaaugagacacaaaagaacaucaaccaaaucauucaacaugguacaagcauuuggacuacgaggcccaggagaccuacaaggaaacuucggagaucuacaacuaaacaaauuagguaccgaagacccacgauggccacaaauagcagaacuagcaccaacagcaucagcauucaugggaaugucacaauuuaaacuaacucaucaaaacaacgaugaccauggaaauccaguauacuuccuaagauacaguggagcaauaaaacuagacccaaaaaaccccaacuauaacaaauggcuagaacuauuagaacaaaacauagacgcauacaaaacauucccaaaaaaagaaaaaaaacaaaaagccccaaaagaagaaucaaccgaucaaaugagcgaaccaccaaaagaacauagaguacaaggaacacaaagaacaagaaccagaccaagcguacaaccaggaccaaugauagauguaaacacagauuaa

SEQ ID NO: 1191 - RNA, 1242 nt, Artificial Sequence
  derived and/or modified CDS sequence (opt6) from MERS-CoV__AGH58724__N
auggcaucaccagcagcaccaagagcuguaucauucgcauacaacaaugacaucacaaacacaaaccuaucaagaggaagaggcagaaacccaaaaccacgcgcagcaccaaauaacacuguaucaugguacaccggauuaacacagcacggcaaaguaccacuaacauuccccccuggacaaggagucccauuaaacgcaaacucaacaccagcccaaaaugcaggauacuggcgaagacaagacagaaaaauuaacacuggcaacgguauaaaacagcucgcgccaagaugguauuuuuauuauacaggaaccggaccagaagccgcauuaccauuuagagcuguuaaagaugguauaguauggguacacgaagacggagcaacagacgcaccaucuacauucggcacacgcaauccaaacaacgauagcgcaauaguaacacaauucgcacccggaaccaaacucccaaaaaauuuucacauagaaggaacaggagguaacucacaaucaucaucaagagcaucaucaguaucacgaaacucaucaagaucaucuucacaagguucaagaagcggaaacucaacaagaggaacaucaccaggaccaagcggaauaggggcaguaggaggagaccuauuauaccuagaucuacuaaaucgccuacaagcacuagaauccggcaaagucaaacaaucccaaccaaaaguaauaacuaaaaaagacgcagcagcagccaaaaacaaaaugagacauaaaagaaccagcacaaaaucauucaacaugguacaagcauuuggacuaagaggacccggugaucuacaaggaaauuucggagauuuacaauuaaacaaauuaggaacagaagacccacgauggccccaaauagcagaacuagccccuacagcauccgccuucaugggaaugucacaauucaaacuuacacaccaaaacaaugacgaucauggaaacccaguauacuuucuaagauacucaggagccauaaaacuagaccccaaaaacccuaacuacaacaaauggcuagaauuauuagaacaaaacauagaugcauacaaaacauucccaaaaaaagaaaaaaaacaaaaggcaccuaaagaagaaagcacagaucaaaugagcgaacccccaaaagaacaaagaguccaaggaucaaucacacaaagaacaagaaccagaccaucaguacagccuggaccaaugauagacguaaauacagacuaa

SEQ ID NO: 1192 - RNA, 1242 nt, Artificial Sequence
  derived and/or modified CDS sequence (opt6) from MERS-CoV__AGV08397__N
auggcaucaccagcagcuccaagagcaguauccuucgcagacaacaaugacauaacgaacacaaaccuaaguagaggaagagggagaaacccaaaaccaagagcagcuccuaacaacaccguaucaugguacacaggacuuacacaacacggaaaaguaccacuaacauuuccaccaggacaagguguaccauuaaacgcaaauagcacaccagcacaaaacgccggauacuggcgaagacaagacagaaaaauaaacacaggcaauggaauaaaacaauuagcaccaagaugguauuucuauuacacaggaacaggaccagaagcagcacuaccauucagagcaguaaaagauggaaucgucuggguacaugaagacggagcaacagacgcaccuagcacauuuggaacgcgcaacccaaacaaugacagugcaauuguaacccaauucgcaccaggcaccaaacuaccaaaaaauuuucacauagaaggaacaggaggaaacagccaaucaagcagucgagcaucaagcguaucaagaaacagcucacgaucaagcucacaaggaagucgaucaggaaacagcacaagaggaacaagcccaggcccaagcggaauaggagcaguaggaggcgacuuauuauaccuagaucuccuaaacagauuacaagcauuagaaucaggaaaaguaaaacaaucgcaaccaaaaguaauaacaaaaaaagacgcagcagccgcaaaaaauaaaaugaggcacaaaagaacaucaacaaaaucauuuaacaugguacaagcauucggauuaagagguccaggagaucugcaaggaaacuucggggacuuacaacuaaauaaacuaggaaccgaagacccaagauggccacaaauagcggaauuagcacccacagcaucagccuucaugggaaugucacaauucaaacucacacaccaaaacaacgacgaccacggaaacccaguauacuucuuaagauacucuggugcaauaaaauuagacccaaaaaaucccaacuacaauaaaugguuagaauuacuagaacagaacauagacgcauacaaaacauuccccaaaaaagaaaaaaaacaaaaagcaccaaaagaagaacuaacagaucaaauguccgaaccaccuaaagaacaaagaguccaaggaucuauaacacaaagaacaagaacacgaccaucaguacaaccaggaccaaugaucgacgucaacacagacuaa

SEQ ID NO: 1193 - RNA, 1242 nt, Artificial Sequence
  derived and/or modified CDS sequence (opt6) from MERS-CoV__AGV08415__N
auggccucaccagcagcaccacgagcaguuucauucgcagauaacaacgacaucaccaacacaaaccuaucaagaggcagaggaagaaacccaaaaccaagagccgcaccaaacaacacaguaagcugguauacaggcuuaacccaacacggcaaaguuccucuaacauucccaccaggccagggcguaccucuaaacgcaaacuccacaccagcacaaaaugcgggauacuggagaagacaagacagaaaaauaaacacaggaaauggaaucaaacaauuagcaccaagaugguacuucuacuacacaggaacaggacccgaagcagcacuaccauucagagcaguaaaagacggaauaguauggguacacgaagauggcgccacagaugcaccaagcacauuuggcacaagaaauccaaacaaugacagugcaauaguaacacaauucgcaccugguacaaaauuacccaaaaacuuccauauagaaggaacaggaggaaacagucaaucaucuucaagagcaucaaguguaagcagaaacucaucaagaaguucaagccaagguucaagaucaggaaauucaacaagaggaacaucaccaggaccaucaggaauaggagccguaggaggugacuuacucuacuuagaucuacuaaacagauuacaagcauuagaaagcggaaaaguaaaacaaagccaaccaaaagucauaacuaaaaaagaugccgcagcagcaaaaaacaaaaugagacauaaaagaacaagcacaaaaucauucaauaugguacaagccuucggacuccgcggaccaggcgacuuacaaggaaacuucggagaucuccaauuaaauaaacuaggcacagaagacccaagauggccacaaauagcagaacuagcaccaacugcaagcgcauuuaugggaaugucacaauuuaaacuaacacaccaaaauaacgacgaccacggaaacccaguauauuuucuacgauacaguggagcaauaaaacuagacccaaaaaacccaaauuauaacaaaugguuagaauuauuagaacaaaauauagacgccuauaaaacauucccaaaaaaagaaaaaaaacaaaaagcaccaaaagaggaaucaacugaccaaaugucagaaccucccaaagaacaaagaguacaaggaucaauaacccaaagaaccagaacaagacccucuguacaaccuggaccaaugauugacgucaacacagacuaa

SEQ ID NO: 1194 - RNA, 1242 nt, Artificial Sequence
  derived and/or modified CDS sequence (opt6) from MERS-CoV__AGV08487__N
auggcaagcccagccgcuccaagagccguaucauucgccgauaacaacgacauaacuaacaccaacuuaaguagaggacgaggaagaaauccaaaaccaagagcagcaccaaauaacaccguaucaugguauacuggacuaacacaacauggaaaagucccacuaacauucccaccaggacaaggagugccacuaaaugcaaauucaacaccagcccagaaugcaggauauuggagaagacaagauagaaaaauaaacacuggaaauggaaucaaacaauuagcaccaagaugguacuucuacuacaccggaacagggccagaagcagcauuaccauuucgagcagucaaagacggaauaguauggguacacgaacacggagcaacagacgcaccaucuacauuuggaacaagaaaccccaacaaugacagcgcaauaguaacccaauucgcucccggaaccaaauuaccaaaaaacuuucacauagaaggcaccggaggaaacucacaaagcuccuccagagcaucauccguaagccgcaacucaucacguucaagcucacaaggauccagaucagguaacucaaccagaggcacaaguccaggcccaagcggaauaggcgcaguaggaggagaccuuuuauaccucgauuuacuaaacagacuacaagcacuugagucaggaaaaguaaaacaaucacaacccaaaguaauaacaaaaaaagacgcagcagcagcuaaaaacaaaaugcgacacaaaagaacuucaacaaaaucauuuaauaugguacaagcauuugguuuaagaggaccaggagacuuacaaggaaauuucggugaccuacaacuaaacaaauuaggaacugaagacccaagauggccacaaauagcagaauuagcacccacagcaucagcauucaugggcaugucacaauucaaacuaacacaccaaaacaacgaugaccacggcaacccaguauacuuucuaagauacagcggagccauaaaacuagacccaaaaaauccaaauuacaacaaaugguuagaacucuuagaacaaaacauagaugcuuauaaaacuuuuccaaaaaaagaaaaaaaacaaaaagcaccaaaagaagaaucaacagaucaaaugagcgaaccaccaaaagaacaaagaguucaaggaucuaucacacaaagaacgagaacaaggccaucaguacaaccaggaccaaugauagacguaaacacagauuaa

SEQ ID NO: 1195 - RNA, 1242 nt, Artificial Sequence
  derived and/or modified CDS sequence (opt6) from MERS-CoV__AHC74095__N
auggccuccccugcagccccaagagcaguuucauucgcagauaauaacgacauaacaaauacaaaccuaagcagaggaagaggaagaaaccccaaaccaagagcagcaccaaacaacacaguaucaugguauacaggacuaacacaacauggaaaagucccacucacauucccucccggccaaggaguaccauuaaacgcaaauaguacaccagcacaaaaugcaggauacuggagaagacaagacagaaaaauaaacacuggcaacggaauaaaacaacucgcaccaagaugguauuucuacuacacaggaacaggaccagaagcagcauuaccauuuagagcagucaaagauggcauuguuuggguccacgaagacggagcaacugaugcaccaucaacauucggaacacgaaaccccaauaacgaccuagcaauaguaacacaauucgcacccggaacaaaacuuccaaaaaacuuccauauagaaggcacaggugguaacucacaaucaucaucgagagcuucaucaguaucaagaaacucaucuagaucuucaucacagggaucacgaucaggaaacucaaccagaggaaccucaccgggaccuucaggaauaggggcaguuggaggagaccuacuauaccuagauuuacugaauagauuacaggcauuagaaagcggaaaaguaaaacaaucacaaccuaaaguaauaacaaaaaaagacgcagccgccgccaaaaacaaaaugaggcauaaacgaacgucaaccaaaucauucaauaugguacaagccuucggacuacgaggaccaggugaccuacaaggaaacuucggagacuuacaacuuaacaaacuaggaacagaagacccaagauggccccagauugcagaauuagcaccaacagcaagcgcauucaugggaaugucccaauucaaacuaacacaccaaaacaacgaugaucacggaaauccuguauacuuucugcgauacucaggagcaauaaaacuagacccaaaaaaccccaacuacaauaaauggcuagaacuacuagaacaaaauauagacgcauauaaaacauucccaaaaaaagaaaaaaaacaaaaagccccaaaagaagaaucaacagaucaaaugucagaaccaccaaaagaacaaagaguucaaggaucaauaacacaaagaacacgaacaagaccaucaguucaaccagggccaaugauagacguuaacacagacuaa

SEQ ID NO: 1196 - RNA, 1242 nt, Artificial Sequence
  derived and/or modified CDS sequence (opt6) from MERS-CoV__AHI48535__N
auggcaucucccgccgccccaagagcagucagcuucgccgacaacaacgacaucacaaacacaaaucuaucaagaggaagaggaagaaaucccaaaccaagagccgcaccaaauaacacaguaucaugguacacaggucuaacacaacacggcaaaguaccccuaaccuucucaccaggacaaggaguaccacuaaacgcaaacagcacaccagcacaaaacgccggcuacuggagaagacaagacagaaaaaucaacaccgguaacggcauaaaacaacuagcgccccgaugguauuuuuacuauacaggaacaggaccagaagcagcacuacccuuuagagccguaaaagauggaauagucuggguccacgaagacggagccacagacgcaccaucaacauuuggcacacgaaacccaaacaaugauagcgccauaguaacacaauucgcaccuggaacaaaacuaccaaaaaacuuucacauagaaggaacaggaggaaacucacaaucaucaucacgagcaucaucagucuccagaaacucaucuagaucaucaucacaaggcucacgauccggaaacucaaccagaggaacauccccaggaccauccggaauaggagcaguuggaggagaccuccuauacuuagauuuauuaaauagauuacaagcacuagaaucaggaaaaguaaaacaaucacaaccaaaaguaaucacaaaaaaagaugcagcagcagcaaaaaacaaaaugagacacaaaagaacaucaaccaaaaguuuuaacaugguccaagcauucggacuaagaggaccaggagaccuacaaggaaacuuuggcgaucuacaacuaaacaaauuaggaacagaagacccuagauggccacaaauagcugaacuagcuccaacagccucagcauucaugggcaugagucaauuuaaacuaacccaccaaaacaacgaugaccacggaaacccagucuacuuuuuaagauacuccggagcaauaaaacucgauccaaaaaacccaaauuauaacaaaugguuagaauuacuagaacaaaauauagaugcuuacaaaacauucccaaaaaaagaaaaaaaacaaaaagcaccaaaagaagagucaacagaccaaguaucugaaccaccaaaagaacaacgaguacaaggcauaauuacacaaagaacaagaaccagaccaaguguacaaccaggcccaaugauagauguaaacacagacuaa

SEQ ID NO: 1197 - RNA, 1242 nt, Artificial Sequence
  derived and/or modified CDS sequence (opt6) from MERS-CoV__AIL23941__N
auggcaucauuagcagcaccgagagcaguauccuuugcagauaacaacgacauaaccaauacaaacuuaagcagaggaagagguagaaacccuaaaccacgcgcagcaccaaauaacacaguaucaugguacacugguuuaacacaacacggcaaaguaccacuaacuuuccccccaggacaaggcguaccccuaaacgcaaacucuacaccagcccaaaacgcaggauacuggagaagacaagauagaaaaauaaacacaggaaacggcauaaaacaacuagccccaagaugguacuucuacuacacugguacaggaccagaagccgcauuaccauucagagcaguaaaagacggaauaguauggguccacgaacauggagcaacagaugcaccuagcacauucggaacaagaaaccccaacaaugacucagcaauaguaacccaauucgcaccuggaaccaaacuacccaaaaauuuccacauagaaggaacaggagguaacucacaaucaagcucuagagcaaguucaguaucccgaaacucuucaagaucaaguucacaaggaucaagaagcggaaauucaacaagaggaacaucaccagguccaucagguauaggagcaguaggcggagaccuauuauaccucgaccuauuaaacagacuacaagcacuagaaucaggaaaaguaaaacaaucccaaccaaaaguaaucaccaaaaaagaugccgccgcagccaaaaacaaaaugagacacaaaagaacaucaacaaaaagcuuuaacaugguccaagcauucggacucagaggcccaggagacuuacaaggaaacuucggcgacuuacaacuaaauaaacuaggaacagaagacccaagauggccccaaauagcagaauuagcaccaacagcaagugcauucaugggaaugucacaauuuaaauuaacacaccaaaacaacgacgaccauggaaauccaguuuauuuccuaagauacucaggagcaauaaaauuagaucccaaaaacccuaauuacaauaaauggcuagaacuacuagaacaaaauauagaugcauauaaaacauucccaaaaaaagaaaaaaaacaaaaagcaccuaaagaagaaucaaccgaccaaaugagcgaaccaccaaaagaacaaagaguacaaggaucaaucacccaaagaacaagaacaagaccaucaguacaaccaggaccaaugaucgacgucaacacagauuaa

SEQ ID NO: 1198 - RNA, 1242 nt, Artificial Sequence
  derived and/or modified CDS sequence (opt6) from MERS-CoV__AIL23996__N
auggcaucaccagcagccccaagagcaguaucauucgccgacaacaaugacauaaccaacacaaaccuaagcagaggacgaggaagaaauccaaaaccacgagcagcaccaaauaacacaguaaguugguacacaggacuaacacaacaugguaaaguaccacuaacauucccaccaggccaaggcguaccucuaaacgcaaacucaacaccagcacaaaacgcaggauauuggagacgacaagacagaaaaauaaauacaggaaacgguauaaaacaacuagcaccaagaugguacuucuacuacacaggcaccggaccugaagcagcauuacccuucagagccguaaaagacggaaucguaugggugcaugaagacggagcaacagacgcaccaucuaccuuuggaacgagaaaucccaacaacgaucuagcgauaguaacacaauucgcaccaggaacaaaacucccaaaaaacuuccacauagaaggaacaggaggaaauucacaaucaaguucgagagcaucauccguaucacguaacaguucaagaucaaguagucaaggaucaagaucaggaaacaguaccagaggaacaucaccaggcccaucaggaauaggagcaguaggaggcgacuuauuauauuuagaccuauuaaauagacuacaagcacuagaauccggaaaaguaaaacaaucacaaccaaaaguaauaacaaaaaaagacgcagccgcagcaaaaaauaaaaugcgacacaaacgaacaaguacaaaaucauucaauaugguacaagcauucgguuuaagaggaccaggagaucuacaaggaaauuucggagacuuacaacuaaacaaacuuggaacagaagacccaagauggccacaaauagcagaauuagccccaacagcaucagcauucaugggaaugagucaauucaaacucacacaccaaaacaacgacgaucacggaaacccagucuauuuccuacgauacagcggugcaaucaaauuagaccccaaaaaccccaacuacaacaaaugguuagaacuacuagaacaaaauauagaugccuauaaaacauucccaaaaaaagaaaaaaaacaaaaagcaccaaaagaagaaucaacagaccaaaugagugaaccaccaaaagaacaaagaguacaaggcucaauaacacaacacacaagaacaagaccaucaguacaaccaggaccuaugauagacguaaauacagacuaa

SEQ ID NO: 1199 - RNA, 1242 nt, Artificial Sequence
  derived and/or modified CDS sequence (opt6) from MERS-CoV__AIY60565__N
auggcagccccugcagcaccaagagcaguauccuuugcagauaauaacgauauaaccaacacaaacuuaucaagaggaagaggcagaaauccaaaaccaagagcagcacccaacaacacaguaagcugguacacaggccuaacacaacauggaaaaguaccacuaacauuccccccgggacaagguguaccccuaaacgcuaacucaacaccagcacaaaaugcaggauacuggaggagacaagacagaaaaauaaacacagguaacgguauaaaacaacuagccccaagaugguacuuuuacuauacagguacaggaccagaagcagcacuaccauucagagcaguaaaggacggaauaguauggguccacgaagauggagcaacggacgcaccuagcacauucggaacaagaaacccaaauaacgauucagcaaucguaacacaauucgccccaggaacaaaauuaccgaaaaauuuucacauagaaggaacaggaggaaacucacaaucaucauccagagccagcucagucagcagaaauaguaguagaucaucaucacaaggaucaaggucaggaaacucaaccagaggcacaagcccaguaccaaguggaauaggagcaguaggaggagaccuacuauauuuagauuuauuaaacagacuacaagcacuagaaucaggaaaaguaaaacaaagccaaccaaaaguaauaacaaaaaaggacgcagcagcagcaaaaaacaaaaugagacacaaaagaacaucaacaaaaagcuucaauaugguacaagcauucggacuaagaggacccggcgauuuacaagguaacuuuggagauuuacaauuaaacaaacuaggcacagaagauccaagauggccacaaauagcagaauuagcaccgacagcaagcgcauucaugggaaugagccaauucaaauuaacacaucaaaacaaugacgaucacggaaacccuguuuauuucuuaagauacucaggagcaauaaaacuagacccaaaaaacccaaacuauaacaaauggcuagaacuacuagaacaaaauauagacgcauauaaaacuuuuccaaaaaaagaaaaaaaacaaaaagcaccaaaagaagaaucaacagaccaaaugucagaacccccaaaagaacaaagaguacaaggaucaauaacacaaagaacccgaacuagaccuucaguacaaccaggaccaaugauagacguuaacacagauuaa

SEQ ID NO: 1200 - RNA, 1242 nt, Artificial Sequence
  derived and/or modified CDS sequence (opt6) from MERS-CoV__AIZ74424__N
auggcagcaccugcagcaccaagagcaguuaguuucgccgacaacaacgacauaaccaauacaaaccuaucaagaggcagaggucgcaauccaaaaccaagagcagcaccaaacaauacaguaagcugguacacaggauuaacacaacacggcaagguaccacuaacauuuccaccaggacaaggcguaccuuuaaacgccaacucaacaccagcacaaaacgccggauacuggagacgacaagacagaaaaauaaacacaggaaacggaauuaaacaacuagcaccaagaugguauuucuacuacacaggaacagguccagaagccgcacuaccauucagagcaguaaaagacggaauaguauggguacacgaagauggagcaacagaugcaccaucaacauuuggaacacgaaacccaaauaacgacagcgcaauaguaacccaauucgcaccagguacaaaacuccccaaaaacuuccacauagaaggaacaggaggaaauucucaauccucaagccgagcuucaucaguauccagaaauaguuccagaucaucaagucaaggaucaagaagcggaaacagcacaagagguacaucaccaggcccaucaggaauaggcgccguaggaggugaucuauuauaccuagauuuacuaaacagacuacaagcacuagaaucaggaaaaguaaaacaaucacaaccuaaaguaauaacaaaaaaagaugcagcagcagcuaaaaacaaaaugagacauaaacgaacaucaacaaaaucauucaacaugguucaagcauuuggacuaagaggaccaggagaucuacaaggaaauuuuggagaccuacaacuaaacaaauuaggaacugaagauccuagauggccacaaauagcagaacuagcuccaacugcaagcgcauucaugggaaugucacaauucaaauuaacacaccaaaauaacgaugaccacggaaacccagucuauuuccuacgcuauucaggagcaauaaaacucgacccuaaaaaccccaacuauaauaaaugguuagaacuacuagaacaaaacauugacgcauauaaaacauucccaaaaaaagaaaaaaaacaaaaagcgccaaaagaagaaucaacugaccaaaugagcgaaccaccaaaagaacaacgaguccaaggauccauaacacaaagaaccagaacaagaccaucuguacaaccaggaccaaugauagaugucaacacagacuaa

SEQ ID NO: 1201 - RNA, 1242 nt, Artificial Sequence
  derived and/or modified CDS sequence (opt6) from MERS-CoV__AIZ74430__N
auggcagcacccgcagccccaagagcaguuucauucgcagauaacaacgacauaacaaacacuaauuugucaagaggcagggguagaaauccgaaaccacgagccgccccaaacaacacaguaaguugguauacaggccuaacccaacacggaaaaguaccacuaacauucccaccuggacaaggaguaccacuaaaugcaaacagcacaccagcacaaaacgcaggauauuggagaagacaagauagaaaaauaaacacaggaaacggaauaaaacaauuagcaccaagaugguacuucuacuauacaggaacaggcccugaagcagcauuaccauuccgagcgguaaaagacggaauuguauggguacacgaagauggcgcaacggacgccccaaguacauucggaacaagaaauccaaauaacgacucggcaaucguaacccaauucgcaccaggaaccaaacuaccaaaaaauuuccauaucgaaggaacaggaggaaacucacaaucaaguucaagagcuaguucagucucccgaaacaguucacgaucaucaagccaaggaagcagauccggcaauucgacaagaggaacaagcccaggcccaucaggaauaggagcaguaggcggagaccuuuuauauuuagaccuauuaaauagacuucaagcauuagaaagcggcaaaguaaaacaaucacaaccaaaaguaauaaccaaaaaagacgcggcagcagcaaaaaauaaaaugagacacaaaagaacgaguacaaaaucauucaacaugguacaagcauuuggcuuaagaggaccaggagauuuacaaggaaauuuuggagaccuacaacuaaacaaacuaggaacugaagacccacgauggccacaaauagcagaacuagcacccacagcaagugcauuuaugggaaugagccaauuuaaacuaacacaucaaaacaaugacgaccacggaaaccccguauauuucuuacgauauucaggagccauaaaacuagauccaaaaaacccaaauuacaacaaauggcuagaacuauuagaacaaaacauagacgcauacaaaacauuucccaaaaaagaaaaaaaacaaaaagccccaaaagaagaaagcacugaccaaaugucagaaccaccaaaagaacaaagaguacaaggcucaauuacccaaagaaccagaacaagaccaagcguccaaccagggccaaugauagauguaaauacagacuaa

SEQ ID NO: 1202 - RNA, 1242 nt, Artificial Sequence
  derived and/or modified CDS sequence (opt6) from MERS-CoV__AKI29291__N
auggcaucaccagcagcaccgagagcaguaucauucgcagauaauaacgacauaacaaacaccaauuuauccagagguagaggaagaaacccaaaaccaagagcagcaccaaacaauacaguaucaugguacacaggacucacucaacacggaaaagucccacuaacauuuccaccaggucaaggaguaccccuaaacgcaaauucaacccccgcacaaaacgcaggauacuggagaagacaagacagaaaaaucaauacaggaaacggcauaaaacaauuagcaccaagaugguauuucuauuacacuggaacaggaccagaagcagcauuaccauuucgagcaguaaaggacggaaucguauggguacaugaagacggagcaacagacgcaccaucaacauucggcacaagaaacccaaacaaugacagcgcaauaguaacccaauucgcaccaggcacaaaacuaccaaaaaauuuucacauagaaggaacaggcggaaacucccaaucaucuaguagagccuccucaguaucuagaaacagcagcaggucaagcucacaaggaucaagaagcggaaacucaaccagaggaacaucaccaggaccaaguggaauuggcgcaguaggcggagaccuacuauaccuagaccuauuaaauagacuacaagcauuagaaucugguaaaguaaaacaaagccaaccaaaaguuauaaccaaaaaagaugcagcagcagcaaaaaacaaaaugagacauaaaagaacaagcacaaaaucauucaacaugguacaagcauucggacuaagagggccaggagaccuacaaggcaacuucggagaccuacaacuaaacaaauuaggaacugaagacccaagauggccccaaauagcagaacuagcaccuaccgcaucagcauucaugggaaugucacaauucaaacuaacccaccaaaacaacgaugaccacggaaacccagucuacuuccuaagauacaguggagcaauaaaacuagacccaaaaaauccaaacuacaacaaauggcuagaacuacucgaacaaaacaucgacgcuuacaaaacauucccaaaaaaagaaaaaaaacaaaaagcaccaaaagaagagucaaccgaucaaauguccgaaccaccaaaagaacaaagaguacaaggcagcauaacacaaagaauucgaacaagaccaucaguacaaccaggacccaugauagacguaaacacagacuaa

SEQ ID NO: 1203 - RNA, 1242 nt, Artificial Sequence
  derived and/or modified CDS sequence (opt6) from MERS-CoV__AKK52599__N
auggcauccccagcagcaccaugugcaguaucauucgcagacaacaaugacaucaccaacacaaauuuaagcagaggccgaggaagaaacccaaaaccacgcgcagcaccaaacaacacaguaucaugguacaccggauuaacucaacacggaaaaguaccacuaacauucccacccggacaaggaguaccacuaaacgcaaauucaacacccgcccaaaacgcuggauacuggagaagacaagacagaaaaauaaacacaggaaacggaaucaaacaacuagcaccaagaugguacuucuauuacacaggaaccggaccagaagcagcauuaccauuccgagcaguuaaagauggaauaguauggguacacgaagacggagccacugacgcuccaucuacauucggaacaagaaauccaaacaacgauagcgcaaucguaacacaauuugcuccaggaacuaaacuaccuaaaaauuuccacauagaaggaacaggaggaaauucucaaucaucaucacgugcaucuucgguaucacgaaacuccucccgcucaucaucccaaggaucaagaucaggaaauucaaccagaggcacaaguccuggcccaucaggaaucggagcagucgguggagacuuacuauaccuugacuuacuuaacagacuccaagcacuagaaagcggcaaaguaaaacaaucacaaccgaaaguaaucacaaaaaaagacgcagcugcagcaaaaaacaaaaugagacacaaaagaacaucaaccaaaucauuuaauaugguacaagcauucggacucaggggaccaggagaucuacaaggaaacuuuggagacuuacaauuaaacaaacuuggaacagaagacccaagauggccacaaauagcagaacuagcaccaacagcaagugccuucaugggaaugagucaauuuaaauuaacacaccagaacaacgacgaccacggaaauccaguuuacuuuuuaagauacuccggagcaauaaaacuugauccaaaaaacccaaauuacaacaaaugguuagaacuacuagaacaaaacauagaugccuacaaaaccuuuccuaaaaaagaaaaaaaacaaaaagcaccaaaagaagaaucaacagaccaaaugagcgaaccaccaaaagaacaaagaguacaaggaucaauaacacaaaggacccgaaccagacccucaguacaacccggcccaaugauagacguaaauacugauuaa

SEQ ID NO: 1204 - RNA, 1242 nt, Artificial Sequence
  derived and/or modified CDS sequence (opt6) from MERS-CoV__AKN24774__N
auggcaucacccgcagccccacgagcaguaucuuuugcagacaauaacgacauaacaaacacaaaccuaucaagaggaagaggaagaaacccaaaacccagagcagcaccaaacaauacugucucaugguacacaggauuaacgcaacacggaaaaguuccacucacauucccaccaggacaaggaguaccucuaaaugcaaacucaacaccagcacaaaacgccggauauuggcgaagacaagacagaaaaauaaacacaggaaauggaaucaaacaacuugcaccaagaugguacuuuuauuacacaggcacaggaccagaagccgcacuaccauuuagagccguaaaagauggcauaguauggguacacgaagacggagcaaccgacgcaccaucaacauucggaacaagaaacccuaacaaugaccuagcaauaguaacacaauuugcaccaggaacaaaacuaccaaaaaacuuccacauagaaggaacaggaggaaacucacaaucaaguucaagagcaagcucaguauccagaaacagcaguagaucaaguucacaaggcucaagaagcggaaacucuacaagaggaacaucacccggcccaucaggaauaggagcaguagguggagacuuauuauaccuagauuuacuaaacagauuacaagcacuagaaucaggaaaagucaaacaaucacaacccaaaguaauaacaaaaaaagacgcugcagcagccaaaaacaaaaugagacauaaaagaacuucaacaaaaaguuucaacaugguacaagcauuuggauuaagaggcccaggagaccuucaaggaaacuucggagauuuacaauuaaauaaauuaggaaccgaagacccacgauggccucaaaucgcagaacuuguacccacagcgucagcauucaugggaaugucacaauucaaauuaacccaccaaaauaaugacgaccacggaaacccaguauauuuccuaagauacucaggagccauaaaauuagacccaaaaaacccaaauuacaacaaauggcucgaacuauuagaacaaaacauagacgcauacaaaacauucccaaaaaaagaaaaaaaacaaaaagcuccaaaagaagaaucaacagaccaaaugagugaaccaccaaaagaacaaagaguacaaggaucaauaacacaacauacaagaacaagaccaucaguacaaccaggaccaaugauagauguaaacaccgauuaa

SEQ ID NO: 1205 - RNA, 1242 nt, Artificial Sequence
  derived and/or modified CDS sequence (opt6) from MERS-CoV__ALW82676__N
auggcauccccagcagcaccaagagcuguaucauucgcagauaacaacgauacaacaaauacaaaucuaucaagaggaagagguagaaauccaaaaccaagagcagcaccaaacaacacaguaucaugguauacaggauuaacacaacauggaaaaguaccauuaaccuucccaccaggccaagguguaccucuuaacgcaaacucuacaccagcacaaaaugcagguuacuggagacgccaagacagaaaaauaaacacaggaaacgguauaaaacaauuagcuccacgaugguacuucuacuauacaggaacaggaccagaagcagcucuaccauucagagcaguaaaagacggaauaguauggguacacgaagacggagcuaccgacgcaccaucaacuuuuggaacaagaaacccaaauaaugacagugcaauaguaacacaauuugcaccaggaacaaaacuaccaaaaaacuuucacauagaagggacagguggcaacucacaaucaucaucaagagcgaguucuguaucaagaaauucaucucgaagcucaucacaagguagcagaagcggaaacucuacuagaggaacaucaccaggaccauccggaauaggagcgguaggcggagacuuauuauacuuagaccuacuaaacagauuacaagcuuuagaaucaggaaaaguaaaacaaucacaaccaaaaguaauaacuaaaaaagaugcagcagcagccaaaaauaaaaugcgacacaaacgaaccucaacaaaaucauucaacaugguucaagcauucggacucaggggaccgggagaccuacaaggaaacuucggcgaccuacaacuaaauaaauuagggacagaagaccccagauggccacaaauagcagaacucgcaccaacagcaagugcauuuaugggaaugagccaauuuaaauuaacacaucaaaacaacgacgaccacggaaacccagucuacuuccuacgauauucaggcgccauaaaauuagacccaaaaaaccccaacuacaauaaaugguuagaauuauuagaacaaaacauugacgcauauaaaacauuccccaaaaaagaaaaaaaacaaaaagcaccaaaagaagaaucaacagaccaaaugucagaaccaccaaaagaacaaagaguacaagguucaauaacucaaagaacaaggacaagaccaucaguacaaccaggacccaugauagacguaaacacagauuag

SEQ ID NO: 1206 - RNA, 1242 nt, Artificial Sequence
  derived and/or modified CDS sequence (opt6) from MERS-CoV__AMQ49033__N
auggccucacccgcagcaccaagagcaguauucuucgcagacaacaaugacauaacaaacacuaaucuaucacgaggaagaggaagaaacccaaaaccaagagcagcaccaaauaauaccguaucaugguacacagggcuaacacaacacggaaaaguaccacuaaccuuuccaccaggccaaggaguaccccuaaacgcaaacuccacaccagcccaaaacgcaggauacuggagaagacaagacagaaaaauaaacacgggcaauggaauaaaacaacuagcaccaagaugguacuucuauuacacagguacaggcccagaagccgcacuaccauucagagcaguaaaagacggaauaguauggguacaugaagauggagcaaccgacgccccaucaacauuuggaaccagaaauccuaacaacgauucagcaauagucacucaauucgcaccaggaacaaaauuaccaaaaaacuuccacauagaaggaacaggcggaaacucccaaagcucaaguagagcaucauccguaucaagaaacucaucccgaagcucaagccaaggaagccgaagcggaaacucaacuagaggaacaaguccaggaccaagcggaauaggagcaguaggaggagaccuauuauauuuagaucuucugaacagacuacaagcauuagaaucagguaaagucaaacaaucacaaccaaaaguuauaacuaaaaaagaugcagcagcagcaaaaaauaaaaugagacauaaaagaacaucaacaaaaucauucaauaugguacaagcauucggacuaaggggaccaggcgaccuacaaggaaacuucggagauuuacaauucaacaaacucggcacagaagauccaagauggccacaaauagcagaauuagcacccacagccucagcauucaugggcaugagccaauucaaacuaacccaucaaaacaacgacgaccacggaaacccaguauauuucuugcgauauucaggagcaauaaaacuagauccaaaaaacccaaacuauaacaaauggcuagaauuacuagaacaaaacauagaugcauauaaaacauucccaaaaaaagaaaaaaaacaaaaagcacccaaagaagaaucaacagaccaaaugucagaaccuccaaaagaacaaagaguccaaggaucaauaacacaaagaacacgaacuagaccaucuguacaaccagguccaaugauagacgucaacacagauuaa

SEQ ID NO: 1207 - RNA, 1242 nt, Artificial Sequence
  derived and/or modified CDS sequence (opt6) from MERS-CoV__AHL18098__N
auggcaucaucugcagcaccaagagcaguaucauucgcagauaauaacgauauaacaaauacaaaucuaucaagaggccgaggaagaaacccaaaaccaagagcagcaccuaacaacacaguuaguugguacacaggacucacacaacacggaaaagucccauuaacauucccucccggccaaggaguacccuuaaaugcaaacagcacuccagcacaaaaugcaggauacuggagaagacaagacagaaaaauaaacacaggaaacgguauaaaacaacuagccccaagaugguacuucuacuacaccggaacagguccagaagcagccuuaccauucagagcaguaaaagacgguauaguauggguacacgaagauggagcaacagacgccccaagcacauuuggcacccgcaacccaaauaacgacucagcuauaguaacacaauucgcuccaggaacaaaauuacccaaaaacuuucauauagaaggaacaggcggaaacucucaaaguucaucacgagcaagcucagucucaagaaacagcucaagaucaucaucacaaggaucaagaagcggaaacagcacaagaggcaccagcccaggaccaucaggcauaggagcaguaggaggagauuuauuauacuuagaccuacuaaacagacugcaagcauuagaaucaggaaaaguaaaacaaagccaaccaaaaguaauuacuaagaaagacgcagcagcagcuaaaaauaaaaugagacacaaaagaaccaguacaaaaucauucaacaugguacaagcauuuggacuacgaggaccuggagaucuacaaggaaacuuuggagacuuacaacuaaauaaauuaggaacagaagauccaagauggccacaaauagcagaauuagcaccaacagcaucagcauuuaugggaaugucacaauucaaacucacacaucaaaacaaugacgaccacggaaacccaguauacuucuuacgauauucaggagcaauaaaacuugauccgaaaaauccaaauuauaacaaaugguuagaauuauuagaacaaaauauagaugcauacaaaacauuuccaaagaaagaaaauaaacaaaaagcaccaaaagaagaaucaaccgaccaaaugucagaaccaccaaaagaacaacgaguacaaggaucaauaacacaaaggacaagaacaagaccaaguguacaaccaggaccaaugauagauguaaacacagauuaa

SEQ ID NO: 1208 - RNA, 1242 nt, Artificial Sequence
  derived and/or modified CDS sequence (opt6) from MERS-CoV__AHX00738__N
auggcagcaccagcagcaccacgagcaguaucauuugcagacaacaacgauauaacaaauaccaacaugucaagaggaagaggaagaaauccaaaaccacgagcagcaccaaacaacacaguuucuugguacacuggauuaacccaacacgguaaaguaccacuaacauucccucccggccaaggaguaccauuaaacgcaaacucaacaccagcccaaaacgcaggauacuggcgacgacaagacagaaaaauaaacaccggaaauggaaucaaacaauuagcaccaagaugguacuucuacuacacaggaacaggcccagaagcagcacuaccauuccgagcagucaaggacgguauaguauggguacacgaagacggagcuacagacgcaccaucaacauucggaacacgaaacccaaacaacgacucagcaauaguaacacaauucgcaccaggaacaaaauuaccaaaaaacuuccauauagaaggcacuggaggaaacucacaaucaucuucaagagcaaguucaguaagccgaaauucauccagaucaucaucucaaggaucaaggagcggaaacucuacaagaggaacaucaccaggaccaucaggaauaggagcagucggaggagaccuauuauaccuagauuuacuaaaccgacuacaagcacucgaaucaggcaaaguuaaacaaucacaaccaaaaguaaucacgaaaaaagaugcagcagcagcaaaaaauaaaaugagacacaaaagaacaaguaccaaaucauucaacaugguacaagcauuuggacuuagagguccaggagaccuacaaggaaauuuuggagacuuacaacuuaacaaacuuggaaccgaagauccaagauggccacaaauagcagaacuagccccaacugccagcgccuucaugggaaugucacaauucaaacuaacacaucaaaauaacgacgaccacggcaauccaguauacuuccuaagauauucaggagcaauaaaacucgacccaaaaaaucccaacuauaacaaauggcuagaacuacuugaacaaaacauagaugcauacaaaacauucccaaaaaaagaaaaaaaacaaaaagcaccaaaagaagaaucaacagaccaaaugagcgaaccaccaaaagaacaaagaguacaagguucaauaacacaaagaacaagaacaagaccaucaguacaaccaggaccaaugauagauguaaacacagacuaa

SEQ ID NO: 1209 - RNA, 1242 nt, Artificial Sequence
  derived and/or modified CDS sequence (opt6) from MERS-CoV__AHY22561__N
auggcaucaccagcagcaccacgagcagucucauucgcagacaacaaugauaucaccaacacaaaccuaucaagaggacgcggaagaaacccaaaaccaagagcagcaccaaacaauacaguaagcugguacacaggccuaacacaacauggaaaaguaccauuaacauucccuccaggacaaggcguaccauuaaacgcaaauucaacaccagcacaaaacgcagguuauuggagacgacaagacaggaaaauaaacacaggaaacggaauaaaacaauuagccccaagaugguacuucuauuacacaggaacaggcccagaagcagcacuaccauuccgagcaguuaaagauggaauaguauggguacaugaagacggagcaacagacgcaccaucaacauuuggaaccagaaaccccaacaacgacagcgcaauaguaacacaauucgcaccaggcacaaaacuacccaaaaacuuccacauagaaggaacaggcgguaauucccaaucauccucaagagcaucuucaguaucaagaaacagcucaaggucaagcucacaaggaucaagaucaggaaacucaacuagaggaacuucaccaggaccaucagguauaggagcaguaggcggcgacuuacuauaucuagaccuccuaaacagauuacaagcccuagaaucaggaaaaguaaaacaaucacaaccaaaaguuauaacgaaaaaagaugcagcagcagcaaaaaauaaaaugagacacaaaagaacaagcacaaaaucauucaacaugguacaagcauuuggacuaagaggcccaggugacuuacaagguaacuucggagaucuacaauuaaacaaacuaggaacagaagacccacgauggccacaaauugcagaauuagcuccaacagccucagcauuuaugggaaugagccaauucaaacuaacacaccaaaauaacgacgaucacggcaacccaguuuauuuccuaagauacucaggagccauaaaauuagacccaaaaaacccgaauuacaacaaauggcuagaacuacuggaacaaaacauagacgccuacaaaacuuuucccaaaaaagaaaauaaacaaaaagcaccuaaagaagaaagcaccgaucaaaugucagaaccuccuaaagaacaaagaguacaaggcuccauaacacaaagaacaagaacaagacccucaguccaaccaggaccaaugauagacguaaacaccgauuaa

SEQ ID NO: 1210 - RNA, 1242 nt, Artificial Sequence
  derived and/or modified CDS sequence (opt6) from MERS-CoV__AHY22571__N
auggccgcaccagcagcacccagagcagucaguuucgcagacaacaaugacauaacaaauacaaacuuauccagaggaagaggcagaaauccuaaaccaagagccgcuccaaacaauacaguaucaugguacacgggauuaacacaacacgguaaagucccacuaacauuuccaccaggacaaggcguaccauuaaacgcaaauucaacaccagcacaaaacgcaggcuauuggaggcgccaagaucgaaaaaucaacacaggcaauggaauaaaacaacuagcaccacgaugguacuucuacuacacaggaacaggcccagaagcagcucucccauuuagagcaguuaaagacggaauuguauggguacacgaagauggagcaaccgacgcgccaagcacauucggaacaagaaaccccaacaacgacagugcaauaguaacacaauucgcaccaggcacaaaacuaccaaaaaauuuccacaucgaaggaacaggaggaaacucucaaucaucauccagagcaucaucagucucaagaaacucuaguagauccucaagccaaggaucuagaaguagaaacucaaccagaggaacaaguccaggaccuagcggaauaggagccguagggggagaccuauuauaccuagaucuacuaaauagacuacaagcacuagaaucuggcaaagucaaacaaucacaaccaaaaguuauaacaaaaaaagacgcagcagcugccaaaaauaaaaugagacacaaaagaaccaguacaaaaucauucaauauggugcaagcauucggacuaagaggaccaggagaucuacaaggaaacuucggugacuuacaauuaaacaaacuagguaccgaagacccccgauggccacaaauagccgaacuagcuccaacugcaucagcauucaugggaaugagccaauucaaacucacacaccaaaacaaugacgaccacggaaacccaguauacuuccuaagauauucaggagcuauaaaauuagauccaaaaaacccaaacuacaacaaauggcuagaauuacuagaacaaaacauagacgcuuacaaaacauuuccuaaaaaagaaaacaaacaaaaagcccccaaagaagaaucaacagaccaaaugucagaaccaccaaaagaacaaagaguacaaggaagcauaacacaaagaacacgaaccagacccuccguacaacccgggccaaugauagacguaaauacagauuaa

SEQ ID NO: 1211 - RNA, 1242 nt, Artificial Sequence
  derived and/or modified CDS sequence (opt6) from MERS-CoV__ALA49381__N
auggcaucaccagcugccccaagagcagucucauucgcagacaacaacgacauaacaaacacaaaccuaucaagaggaagaggaagaaacccaaaaccaagagccgcaccaaauaacacaguaaguugguacacaggacucacacaacacggaaaaguucccuuaaccuuucccccaggacaaggaguaccauuaaaugcuaauucaacaccagcacaaaaugcggguuacuggagaagacaagacaggaaaauaaauacaggcaacggaauaaaacaacucgcaccaagaugguauuuuuauuacacaggcacaggaccggaagccgcauuacccuucagagcagucaaagauggaauaguauggguacacgaagacggugcaaccgacgcaccaucaacauucggcaccagaaacccaaacaaugacagcgcaaucguuacacaauucgcaccaggaacaaaacuaccaaaaaacuuccacauagaaggaaccggaggaaacucacaaucaucaucacgagcaucaucuguuucacgaaauucaucgagaucaucaucacaaggcucaagaucaggaaauaguacaagaggcucaaguccagguccaucaggcauaggagcaguuggcggagaccuacuauaccuagaccuacuaaacagauuacaagcacuagaaucgggaaaaguaaaacaaucucaaccaaaaguuauaaccaaaaaagacgccgcagcagccaaaaacaaaaugagacacaaaagaacuaguacaaaaucauucaacaugguacaagcauucggacuaagaggcccaggagaccuacaaggaaauuucggagaucuucaacuaaacaaacuaggaacagaagacccacgauggccacaaauagccgaauuagcuccaacagcaucagcauucaugggcaugucacaauucaaacuaacacaucaaaauaacgacgaucacggaaacccaguauacuuccuaagauacucaggagcaauaaaauuagauccuaaaaauccaaacuacaauaaaugguuagaauuacuagaacaaaauauagacgcauauaaaacuuucccaaaaaaagaaaaaaaacaaaaagcaccaaaagaagaaucuacugaccaaaugagcgaaccacccaaagaacaaagaguccagggauccauaacacaaagaacaagaacaagaccauccguacaaccaggucccaugauagacguaaauacagacuaa

SEQ ID NO: 1212 - RNA, 1242 nt, Artificial Sequence
  derived and/or modified CDS sequence (opt6) from MERS-CoV__ALA49392__N
auggcaaguccugcagcaccuagagcagucagcuucgcagacaacaaugauauaacaaacacaaaccuaucacgaggaagaggaagaaauccaaaacccagagcagcaccaaacaacaccguaucaugguacacaggacuaacacaacauggaaaaguaccguuaacauucccaccaggacaaggaguaccauuaaacgcaaacucuacaccagcccaaaacgcaggauacuggagaagacaagauagaaaaauaaacacaggaaauggaauaaaacaauuagcaccuagaugguacuuuuauuauaccggaacaggaccugaagcagcauuaccauuccgagcaguaaaggacggcaucguauggguacaugaagacggagcaacagaugcacccucaacuuuuggaaccagaaacccaaacaaugacagcgcaauaguaacacaauuugccccaggaacaaaacuaccaaaaaacuuucacauagaaggaacaggaggaaacucacaaaguaguucaagagccucaaguguaucaagaaacucaucaagaucaucaucacaaggaagccgaucaggaaauucaacacgaggaucaagucccggaccaaguggcauaggagcaguaggaggagacuuacuauaccucgaccuccugaaccgauuacaagcacucgaaucgggaaaaguaaaacaaucacaaccuaaaguaauaaccaaaaaagacgccgcagcagcaaaaaacaaaaugagacacaaaagaacaagcacaaaauccuucaacaugguacaagcauuuggacuaagaggaccaggagaucuacaaggaaacuuuggagacuuacaacuaaauaaauuaggaacagaagacccacgauggccccaaauagcagaacuugcuccaacagcaucagccuuuauggguaugucacaauuuaaauuaacacaucaaaauaacgacgaccacggaaacccaguauacuucuuaagauauagcggagcuauaaaacuagacccaaaaaaccccaacuacaauaaauggcuugaacuacuagaacaaaacauagacgccuacaaaacauuucccaaaaaagaaaaaaaacaaaaagccccaaaagaagagucaacagaccaaaugucagaaccaccaaaagaacaaagaguacgaggaucaauaacacaacgaacaagaacaagaccaucaguacaaccuggaccaaugaucgacguaaauacugacuaa

SEQ ID NO: 1213 - RNA, 1242 nt, Artificial Sequence
  derived and/or modified CDS sequence (opt6) from MERS-CoV__ALA49601__N
auggcaucaccagccgcaccaagagccguuucauuugcagacaacaacgacauaacaaacaccaaccuaucacgaggaagaggaagaaacccaaaaccaagagcagcaccgaauaauacaguaucuugguacacaggcuuaacacaacacggaaaaguaccauuaaccuucccaccaggacaaggaguaccauuaaaugcaaacucaacaccagcacaaaacgcaggauacuggagaagacaagauagaaaaauaaacacaggaaauggcauaaaacaacuugcaccaagaugguacuuuuacuacacaggaacaggaccagaagcagcucuaccauucagagcgguaaaagacgguaucguauggguacacgaagauggagcaacugacgcaccaucaacauuuggaacaagaaaccccaacaacgacagcgcaauaguaacacaauucgcgccgggaacaaaauuaccaaaaaacuuucauaucgaaggaacagguggcaacucacaaagcucaucaagagcaucaucgguaucaagaaauagcucaagaagcagcagccaaggaucaagaucuggaaacuccacaagaggaacaucaccaggacuaucaggaauaggugcaguaggaggagaccuauuauaucuagacuuacuaaacagacuucaagcauuagaaucagggaaagucaaacaaucucaaccaaaaguaauaacaaaaaaagacgcagccgcagcaaaaaauaaaaugagacacaaaagaacaucaacaaaaucauuuaacaugguacaagcauucggacuaagaggcccaggcgaucuccaaggaaacuucggagaccuacaacucaacaaacuaggaacagaagacccgagauggccacaaaucgcagaacuagcucccacagcauccgcauucaugggaaugucacaguuuaaacuaacucaucaaaacaacgacgaccacggaaauccuguauacuuccuaagauacucaggugcaauaaaauuagacccuaaaaacccaaauuauaauaaaugguuagaacuauuggaacaaaacauagacgcauacaaaacauucccaaaaaaagaaaaaaaacaaaaagcaccaaaagaagaaucaacagaccaaaugucagaacccccaaaagaacaaagaguccaaggaucaauaacacaaagaacacgaacaaggcccucaguacaaccuggacccaugauagauguaaacacagauuaa

SEQ ID NO: 1214 - RNA, 1242 nt, Artificial Sequence
  derived and/or modified CDS sequence (opt6) from MERS-CoV__ALA49843__N
auggcaucaccagcagcaccaagagcaguauccuucgcagacaauaacgacauaacaaacacuaacuuaagccgaggaagaggaagaaacccaaaaccaagagcagccccaaacaauacaguauccugguacacaggcuuaacacaacacggcaaaguuccacucacauucccuccgggacaaggcguaccacucaacgccaacucaacgccagcacaaaacgcagguuacuggcgacgacaagacagaaaaaucaacacgggaaacggaauaaaacaacuagcaccaagaugguacuuuuacuacacaggaacaggaccagaagcagcauuaccauucagagcaguaaaagacggaauaguauggguacacgaagacggggcaacagacgcuccauccacauucgguacaagaaacccaaacaacgacucagcaauaguaacucaauuugcaccaggaaccaaauuaccaaaaaauuuucacauagaaggaacaggaggaaacagccaaucaagcuccagagcgagcucagucucaagaaacucauccagaucaucaucccaaggaucaagaucaggaaacuccacaagaugcacaagcccagguccuucaggaauaggugcuguaggcggagaucuacuauaccuagaccuucuaaacagguuacaagcauuagaaucaggaaaagucaaacaaagccaaccuaaaguuauaacaaaaaaagacgcagcagcagcaaaaaacaaaaugcgacacaaaagaacaagcacaaaaucauuuaauaugguacaagcauuuggacuaagaggaccaggagaccuacaaggcaacuucggagacuuacaacuuaacaaauuaggaacagaagacccacgcuggccacaaauagcagaauuagcaccuacagcaagcgcauucauggguaugucacaauucaaacuaacccaucaaaacaacgacgaucacggaaacccaguauacuuucuaagauacaguggagcaauaaaacuagacccaaaaaacccaaauuacaauaaauggcucgaacuauuagaacaaaacauagacgcauacaaaaccuuuccaaaaaaagaaaaaaaacaaaaagcaccuaaagaagaaaguacugaccaaaugucagaaccaccaaaagaacaaagaguacaaggaagcauaacccaaagaacuagaacaagaccaucaguccaaccaggaccaaugauagauguaaacaccgacuaa

SEQ ID NO: 1215 - RNA, 1242 nt, Artificial Sequence
  derived and/or modified CDS sequence (opt6) from MERS-CoV__ALA49865__N
auggcaucaccggcugcaccacgagcaguaagcuuugcugauaacaacgacauaacaaauaccaaccuaucaagaggaagaggaagaaacccaaaaccccgagcagcuccaaacaacaccguaagcugguacacuggauuaacucaacacggaaaaguaccacuaacauuuccaccaggacaaggaguaccccuaaacgcaaacucaacccccgcacaaaacgcagguuacuggagaagacaagacagaaaaauaaacacaggaaacggaaucaaacaacuagcaccaagaugguacuucuacuacauaggaacaggacccgaagcagcauugccuuuuagagcaguaaaagacggaauaguauggguacacgaagacggagcaacagacgcaccaucaacauucggaaccagaaauccaaauaacgacucagcaauaguaacacaauucgcaccaggaacaaaacuaccuaaaaacuuccauauagaaggaacaggaggaaacucacaauccaguagcagagcaagcucaguaucaagaaauagcagucgaucauccucacaaggaucuagaagcggaaauucaacaagagguacuucaccaggacccucaggaauaggagcuguaggaggagaccuauuauaucuugaucuacuaaacagauuacaagcucuugaaucaggaaaaguaaaacaaucacaaccaaaaguaaucacaaaaaaagaugcagcagcagcaaaaaacaaaaugagacauaaaagaacuaguacaaaaagcuucaacauggugcaagcauuuggauuaaggggaccaggagacuuacaaggaaacuucggagaccuacaacuaaacaaauuaggaacagaagaccccagauggccacaaauagcagaacuagcaccaacagcuagugcauucaugggaaugagccaauucaaacuaacucaccaaaauaacgacgaccacggaaaccccguauauuuccuaagauacucaggagcgauaaaacuagacccaaaaaacccaaacuacaacaaauggcuagaauuacucgaacaaaacauagacgcauacaaaacauuucccaaaaaagaaaaaaaacaaaaagcuccuaaagaagaaucuacagaccaaaugucagaaccaccgaaagaacaaaggguacaaggaucaauaacacaaagaacccgaacaaggccaucaguacaaccaggaccaaugaucgauguaaauacagauuaa

SEQ ID NO: 1216 - RNA, 1242 nt, Artificial Sequence
  derived and/or modified CDS sequence (opt6) from MERS-CoV__ALA49909__N
auggcaucaccagcagcaccaagagcagucuccuuugcagauaacaaugacauaacaaacacuaacuuaucccgaggacgaggacgaaacccaaaaccuagagcagcaccaaacaauacaguaagcugguacacaggacuaacucaacacggaaaaguaccucuuacauuucccccaggacaaggcguaccacuuaaugccaacucaacaccagcucaaaacgcaggauauuggagaagacaagacagaaaaauuaacacaggaaauggaauaaaacaauuagcucccagaugguauuucuacuacacaggaaccggaccagaagcagcuuuacccuuuagagccguuaaagauggaauaguauggguccacgaacacggagcaacagacgcaccaucaacauucggaacaagaaacccaaacaacgacucagcuauaguaacacaauucgcacccggaacaaaacuaccuaaaaauuuccacauagaaggaacaggcggaaacucacaaucaucaucacgagcaucaucaguaucaagaaauaguucccgauccagcucccaaggaucacgauccggaaacucaacaagaugcacaucaccaggccccucaggcauaggagcaguaggcggagaccuacuauaccuagauuuacuaaacagacuucaagcacuagaaagcggaaaaguaaaacaaucacaacccaaaguaauaacaaaaaaagacgccgcugcagcaaaaaacaaaaugagacauaaaagaacaucaacaaaaagcuucaauaugguccaagcauucggacuaagaggaccaggagacuuacaaggaaauuucggagaucuacagcuaaauaaacuaggcacagaagacccaagauggccacaaauagcagaacuagcacccacagcaagcgcauuuaugggcaugagccaauuuaaacucacacaccaaaacaacgacgaucacggaaacccaguauacuuccuucgauauagcggcgccauuaaauuagauccaaaaaauccaaauuacaauaaaugguuagaauuacuagaacaaaauauagacgcauacaaaacauuuccaaaaaaagaaaaaaaacaaaaagcaccuaaagaagaaucaacugaccaaaugagcgaaccaccaaaagaacaaagaguacaaggauccauaacacaaagaacaagaacaagaccaucaguacaaccaggacccaugauagacgucaauaccgacuaa

SEQ ID NO: 1217 - RNA, 4062 nt, Artificial Sequence; identical to SEQ ID NO: 305
  derived and/or modified CDS sequence (opt11) from MERS-CoV__AFS88936__S

SEQ ID NO: 1218 - RNA, 4062 nt, Artificial Sequence
  derived and/or modified CDS sequence (opt11) from MERS-CoV__AFY13307__S
augauccacagcguguuccugcucauguuccuuuuaacccccaccgaguccuacgucgacgugggcccggacagcgugaagucugccugcaucgaggucgacauccagcagacguuuuucgacaagacuuggccccgccccaucgacgugucaaaggccgacgggaucaucuacccccagggccguaccuacucgaacaucaccaucacguaccaaggccucuucccguaccagggcgaccacggggacauguacguguacagcgcgggccacgcaaccggcaccacgccccaaaagcuguucgucgccaacuacucccaggacgugaagcaguucgccaacggcuucguggucagaaucggcgcagcggccaacagcaccgggaccgugaucaucucccccagcaccuccgccaccauccggaagaucuaccccgccuucaugcugggcagcuccguggggaacuucagcgacggcaagauggggcgcuucuucaaucacacgcucguccugcugccggacgggugcggcacccuccugcgagcguucuauugcauccuggagccccgcuccgggaaccacugccccgccggcaacagcuacaccuccuucgccaccuaccacacgcccgccaccgacugcagcgacggcaacuacaaccggaacgcguccuuaaacagcuucaaggaguacuucaaccugcgcaacugcaccuucauguacaccuacaauaucacggaggacgagauccuggagugguucgggaucacccagaccgcgcagggcgugcaccuuuucagcucccgguacguugaucuguacgggggcaacauguuccaguucgccacccugccggucuacgacacgauuaaguacuauagcaucaucccccacuccaucagaagcauccaguccgaccggaaggccugggccgccuucuacguguacaagcuccagccccugaccuuccugcuagacuucagcguggacggguacauccgcagggcaaucgacugcggcuucaacgaccugucccagcugcacugcagcuacgaguccuucgacgucgagagcggcguguacuccgugagcuccuucgaggccaagcccagcggguccgucguggaacaggccgagggcguggagugcgacuucagcccgcuccuguccgggaccccgccccaggucuacaacuucaagcgccugguguucaccaacugcaauuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcagugcagggcccaucagccaguucaacuacaagcaguccuucagcaacccgaccugccugauccucgccaccgugccccacaaccugaccaccauaaccaagccccugaaguacuccuacaucaacaagugcagccgguuccucuccgacgaccgcaccgaggucccccaacugguaaacgccaaccaguacagccccugcguguccaucguccccagcacggugugggaggacggggacuacuaccggaagcagcugagcccgcucgagggcggcggguggcugguggccuccggcagcaccgucgcgaugacugagcagcugcagaugggguucggcaucaccguccaguacgggaccgacacgaacuccgugugccccaagcucgaguucgccaacgauaccaagaucgccagccagcugggcaacugugucgaguacucccuguacggcgugagcgggcgcggcguguuccagaacugcaccgccguuggggugcggcagcagcgcuucguguacgacgcguaccagaaccucgucggcuacuacuccgacgacggcaacuacuacugccugcgggccugcgugagcgugcccgucuccgugaucuacgacaaagagaccaagacacacgccacccuguucgggagcguggccugcgagcauaucuccagcaccaugucccaguacagccgcuccacccgcagcaugcugaagcggcgcgacuccacguacggcccgcuccagacccccgucgggugcgugcugggccuggugaacagcagccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaagaguacauccagaccacgauccagaaggugaccgucgacuguaagcaguacgugugcaacggguuccagaagugcgaacagcuucugcgcgaguacggccaguucugcagcaagaucaaccaggcccugcacggggccaaccuccggcaggacgacuccgugcgcaaccuguucgccagcgucaaauccagccaguccagccccaucauccccggcuucgggggcgacuucaaccugacacuccuggagcccguguccaucagcaccggcucccggagcgcgcgcucggccaucgaggaccuccuguucgauaaagugacgaucgccgacccgggguacaugcagggcuacgacgacugcaugcagcaggggcccgccucugcccgggaccugaucugcgcgcaguacgucgccggcuacaaggugcugccgccccucauggacgugaacauggaggccgccuacacgagcucacugcuggggagcauagcgggcgucggcuggaccgccgggcucuccagcuucgcagccauccccuucgcccaguccauauucuaccgccugaacggcguggggaucacacagcagguccugagcgagaaccagaagcucaucgcgaacaaguucaaucaggcccugggcgccaugcagacgggguucaccaccaccaacgaggcauuccacaaggugcaggacgccgugaauaacaacgcgcaggcccuguccaagcucgccucagagcuguccaacacguucggcgccauuagcgccuccaucggcgacaucauccagcggcuggacgugcucgagcaggacgcccagaucgaccgccugaucaacgggcggcugaccacccucaacgccuucgucgcgcagcagcuggugcgcagcgaguccgccgcgcugagcgcccagcucgccaaggacaaggugaacgagugcgucaaggcccaguccaagcggagcggcuuuugcgggcagggcacccacaucguguccuucgucgugaacgcccccaacggccuguacuucaugcacgugggguacuacccaucuaaccacaucgaggucguguccgcguacggccugugcgacgccgccaaccccacgaacugcaucgccccgguaaacggguacuucauaaagaccaacaacacccgcaucgucgaugaguggagcuacaccggcagcuccuucuacgcgcccgagcccaucacgagccucaacaccaaguacguggcgccccaggugaccuaccagaacaucucuaccaaccugccgccgccccugcucgggaacagcaccgguaucgacuuccaggacgagcuggacgaguucuucaagaacgucuccacgagcauccccaacuucggcucccugacccagaucaacaccacccuccuggaccugacguacgagaugcucagccugcagcaggucgugaaggcccuuaaugagaguuacaucgaccucaaggagcugggcaacuacaccuacuacaacaaguggcccugguacaucuggcugggcuucaucgccgggcucguggcccuggcccugugcguguucuucauccucugcugcaccggcugcgggaccaacugcauggguaagcugaagugcaaccggugcugcgaccgcuacgaggaguacgaccuggagccccacaaggugcacguccacuga

SEQ ID NO: 1219 - RNA, 4062 nt, Artificial Sequence; identical to SEQ ID NO: 307
  derived and/or modified CDS sequence (opt11) from MERS-CoV__AGH58717__S

SEQ ID NO: 1220 - RNA, 4062 nt, Artificial Sequence
  derived and/or modified CDS sequence (opt11) from MERS-CoV__AGN52936__S
augauucacagcguguucuuacucauguuccugcugacccccaccgaguccuacguugacgugggcccggacagcaucaaaucagccugcaucgagguggacauccagcagacguucuucgacaagaccuggccccgccccaucgacgucagcaaggccgaugggaucaucuacccccaggguagaacuuacaguaauaucaccaucacguaccagggccucuucccguaccaaggcgaccacggggacauguacguguacagcgcgggccacgccaccggcaccacgccgcagaagcuguucguggccaacuacucgcaggacgucaagcaguucgccaauggguucgugguacgcaucggcgccgcggccaacagcacggggaccgucaucaucucccccucaaccuccgccacgauccggaagaucuaccccgccuucaugcugggcagcuccgucgggaacuucagcgacggcaagaugggccgcuucuucaaccacacgcuagugcuccugccggacgggugcggcacccuccuccgugcguucuacugcauccuggagccccgcuccgggaaccacugccccgccggcaauagcuacaccuccuucgccaccuaccacacgcccgccaccgacugcagcgacggcaacuacaaccguaacgccucccucaacucauucaaggaguacuucaaccugcgcaacuguacguucauguacacauacaauaucacggaggacgagauccuggagugguucggcaucacccagaccgcgcagggcguccaccucuucagcucucgguacguggaccuguacgggggcaacauguuccaguucgccacccugcccguuuaugacacgaucaaguauuauaguaucaucccccacuccauccgcagcauucaguccgaccggaaggccugggccgccuucuacguauacaagcuccagcccuuaaccuuccugcucgacuucagcguggacggguacauccgccgggcgaucgauuguggcuucaaugaccugucccagcugcacugcagcuacgaguccuucgacguggagagcggcgucuacuccgugagcuccuucgaggcuaagccgagcggguccguggucgagcaggccgagggcguggagugugacuucagcccgcuccuguccgggaccccgccccagguguacaacuucaagcgccuggucuucaccaacugcaacuacaaccucacgaagcugcugagccucuucuccgugaacgacuucacuugcagucagaucagccccgccgcgaucgcguccaacugcuacagcucacugauccuggacuacuucagcuacccccucuccaugaaguccgaccugagcgucagcuccgccgggccaaucucacaguucaacuacaagcaguccuucagcaacccgaccugccugauccucgccaccgugccccacaaccugaccaccaucaccaagccccugaaguacucauacaucaacaagugcagcagauugcuguccgacgaccgcaccgaggugccccagcuggucaacgccaaccaguacagccccugcguguccaucgugcccagcacggucugggaggacggggauuacuaucggaagcagcucagcccgcuggaagggggcggguggcucguggccucaggcagcacagucgcgaugaccgagcagcuccagaugggguucggcaucaccguccaguacgggaccgacacgaacucggugugccccaagcuggaguuugccaacgacaccaagaucgcuagccagcuggggaacugcguggaguacucccucuacggcguuagcgggcgcggcguguuccagaacugcaccgccgugggggucaggcagcagcgguucguguacgacgccuaccaaaaccuggugggcuacuacuccgacgacggcaacuacuacugccugcgcgccugugucagcgugcccguguccgugaucuacgacaaggagaccaagacgcacgccacccuguucgggagcguggccugcgagcacaucuccucaaccaugucgcaguacagccgcuccacccgcagcaugcucaagcggcgcgacuccacguacggcccgcugcaaacccccguggggugcguccugggucucgugaacagcucccuguucguggaggacugcaagcugccccucgggcagagccugugcgcccuacccgacaccccgaguacccucacgccccggagcguccgcucggugcccggcgagaugcggcuggcgagcaucgccuucaaccaucccauccagguggaccagcugaacagcuccuacuucaagcucagcauuccgaccaauuucuccuucggcgucacccaggaguacauccagaccaccauccagaaagugaccguggacugcaagcaguacguaugcaacggguuccagaagugcgagcagcugcugcgcgaguacggccaauucugcuccaagaucaaccaggcccuccacggcgccaaccuucggcaggacgacuccgugaggaaccuguucgccagcgugaagucaagccaguccagccccaucauuccaggcuucgggggcgacuucaaccucacccuacuggagcccgucuccaucagcaccggcucccggagcgcgcgauccgccaucgaggaccuccuguucgacaaggugacgauagccgacccgggguauaugcagggguacgacgacugcaugcagcaggggcccgccagcgccagggaccugauaugcgcgcaguacgucgcuggcuacaagguccucccgccccugauggacgugaacauggaggcugccuacaccagcucccugcucggcagcaucgcgggcgugggcuggaccgcagggcuguccagcuucgccgccauccccuucgcccaguccaucuucuaccgacugaacggugucgggaucacccagcagguccucucggaaaaccaaaaguugaucgcgaacaaauucaaccaggcccugggcgcaaugcaaaccggguuuaccaccaccaacgaggccuuccacaaggugcaagacgccgugaacaacaacgcgcaggcccucuccaagcuggccagcgagcuauccaauacguucggcgccaucucagccucuaucggcgacaucauccagcggcucgacgugcuggagcaggacgcgcagaucgaccgccugaucaaugggcggcucaccaccuuaaacgccuucguggcacaacagcugguccggagcgaguccgcggcgcucagcgcccaguuagccaaggacaagguaaacgagugcgugaaggcccagucgaaacggagcggcuucugcgggcagggcacccacaucgucagcuucguggucaacgccccuaacggccuguacuucaugcacgugggguacuaccccucgaaccacaucgagguggucuccgcguacggccucugcgacgcggccaaccccacgaacugcaucgcccccgugaacggguacuucaucaagaccaacaacacccguaucguggaugaguggagcuacaccggcagcucguucuacgcccccgagcccaucacaagccucaacaccaaguacgucgcgccccaggugacuuaccagaacaucucuaccaaccugccgccgcccuuacuagggaacagcaccggaauagacuuccaggacgaacuggacgaguucuucaagaacguguccacgagcauccccaacuuuggcucccugacccagaucaacaccacauugcuggaucucacguacgagaugcugucacugcagcaggucgugaaggcccucaacgaguccuacaucgaccugaaggagcuggggaacuacaccuacuacaacaaguggcccugguacaucuggcucggcuucaucgccgggcugguggcccuagcccucugcgucuucuucauccugugcugcaccggcugcgggaccaacugcaugggcaagcugaagugcaaccggugcugcgaccgcuacgaggaguacgaccucgagccccacaaggugcacguucacuga

SEQ ID NO: 1221 - RNA, 4062 nt, Artificial Sequence; identical to SEQ ID NO: 309
  derived and/or modified CDS sequence (opt11) from MERS-CoV__AGN70951__S

SEQ ID NO: 1222 - RNA, 4062 nt, Artificial Sequence
  derived and/or modified CDS sequence (opt11) from MERS-CoV__AGV08408__S
augauccacucgguguuccugcucauguuccugcugacccccaccgagucauacgucgacgugggccccgauagcgugaaguccgccuguauagagguugacauccagcagacguucuucgauaagaccuggccccgcccuaucgacgugaguaaggccgacgguaucaucuacccccaaggccggaccuacuccaacaucaccaucacguaccagggccucuucccguaccagggcgaccacggggacauguacguuuauagcgcaggccacgccaccggcaccacaccccagaagcuguuugucgccaacuacucccaggacgugaagcaguucgccaacggauucgugguccgcaucggcgccgcggccaauucgaccgggacggugaucaucucucccagcaccuccgcgaccauccggaagaucuaccccgccuucaugcugggcucauccguggggaacuucagcgacggcaagaugggacgcuucuucaaccauacgcucguccugcugccggacgggugcgggacccuccugcgggcguuuuacugcauccuggagccccgcuccgggaaccacugccccgccggcaacagcuacaccuccuucgccacuuaccacacgcccgcuaccgacugcagcgacgggaacuacaaccggaaugccucccucaauagcuucaaggaguacuucaaccugcgcaacugcaccuucauguacaccuacaacauuacggaggacgagauccuagaaugguucgggaucacccagaccgcgcagggcgugcaccucuucagcucccgguacguggaccucuacgggggcaacauguuccaauucgccacccugccggucuacgacacgaucaaguacuacucgaucaucccccacuccauccgcagcauccaguccgaccggaaggccugggccgccuucuacguguacaagcuccagccccugaccuuccugcucgacuucagcguggacggguacauccgccgggcgauugauugcggcuucaacgaccugucccagcugcacugcagcuacgaguccuucgacgucgagagcggcguguacuccgugagcuccuucgaggccaagcccagcgggagugucguggaacaggccgagggcguggaaugcgacuucagcccgcuacuguccgggaccccgccccaggucuacaacuucaagcgccugguguucaccaacugcaacuacaaccucacgaagcugcugagccucuuuuccgucaacgacuucacgugcucgcagaucagccccgccgccauagcguccaacugcuacagcucccuaauccuggacuacuucagcuacccccucuccaugaaguccgaccugagcgugagcuccgccgggcccaucagccaguucaacuacaagcagucauucagcaacccgaccugccugauccucgccaccgugccccacaaccugacgaccaucaccaagccccugaaguacuccuacaucaacaagugcagccggcuccuuuccggggaccgcaccgaggucccgcagcuggugaacgcgaaccaauacagccccugcguguccauugucccgucgacagugugggaggacggugacuauuaccggaagcagcucagcccgcuggagggcgggggcuggcugguggccucagggagcaccgucgcgaugaccgagcagcuccaaaugggcuucgggaucaccgugcaguacggcaccgacacgaacuccgugugccccaagcuggaguucgccaacgacaccaagaucgccagccagcugggcaacugugucgaguacucacucuacggggugagcggccgcgggguguuccagaacuguacggccgucggcgugcggcagcaacgcuucguauacgacgcguaccagaaccuggucggcuacuacuccgacgacggcaacuacuacugccugcgggccugcguguccgugcccgucuccguuauauacgacaaggaaacuaagacgcacgccacccuguucggcagcguggccugcgagcacaucucaagcaccaugucccaguacagccgcuccacgaggaguauguuaaagcggcgcgacuccacguacgggccgcugcagacccccgucggcugcguguuaggucucgugaacagcagccuguucgucgaagacugcaaacuuccccuaggccagagcuugugcgcacugcccgacaccccgagcacccucacgccccgguccgugcgcucugugcccggcgagaugaggcuggcguccaucgccuucaaccaccccauccaggucgaccagcugaacagcuccuacuucaagcucagcauccccaccaacuucuccuucggugugacucaggaguacauccagaccacgauccagaaggugaccgucgacugcaagcaguacgugugcaacggcuuccagaagugcgaacaacugcugagagaguacggucaguucugcagcaagaucaaccaggcccuccacggcgccaaccugcggcaggacgacuccgugcgcaaccuguucgccagcgucaaguccagccagucaagccccauuauccccggguucggcggcgacuucaaccucacccugcuggagccggucuccaucagcaccgggagccgaagcgcgcgcuccgccaucgaggaccuccuguucgacaagguuacgaucgccgacccgggcuauaugcagggguacgacgacuguaugcagcagggccccgccucggcccgggaccugaucugcgcgcaguacgucgccggguacaaggugcucccgccccugauggacgugaacauggaggccgccuacaccagcucccuucucggcagcaucgcgggagucggguggaccgccggccucagcagcuucgccgccauccccuucgcccaauccaucuucuaccgcuuaaacggggugggcaucacccagcagguccucagcgagaaccagaagcugaucgcgaacaaauucaaccaggcccucggggccaugcagacgggcuucaccaccaccaacgaggccuuccggaaggugcaggacgccgugaacaacaacgcgcaggcccucuccaagcuggccagcgagcuguccaacacguucggcgccauuagcgccuccaucggggacaucauccagagacucgacguucuggagcaggaugcgcagaucgaccggcugaucaaugggcgccucaccacccugaacgcauucgucgcccagcaguuagugcggagcgaguccgccgcgcucagcgcccagcuggccaaggauaaggugaaugagugcgucaaggcccaguccaagcgcagcggguuuugcggccagggcacccacaucguaaguuucgucgugaacgccccgaacgggcucuacuucaugcacgugggcuacuaucccagcaaccauaucgaggucguauccgcguacgggcucugcgacgccgccaaccccacgaacugcaucgccccggugaacggcuacuucaucaagaccaacaacacccguaucgucgacgaguggaguuacaccgggagcuccuucuacgcccccgagcccaucacgagccugaacaccaaguacguagcgccccagguuaccuaccaaaacaucaguacaaaccugccgccgccccuccugggcaauaguaccggcauagacuuccaagacgagcuggacgaguucuucaaaaacgucuccacgagcauccccaacuucgggucccucacccagaucaacaccacccugcuggaccucacguacgaaaugcugagccugcagcaggucgugaaggccuugaacgaauccuacauagaccugaaggaacuggguaacuacaccuacuacaacaaguggcccugguacaucuggcucggguucaucgccgggcugguggcccuggcucucugcguguuuuucauucugugcugcaccgggugcggcaccaacugcaugggcaaacugaaguguaaccgcugcugcgaccgcuacgaggaguacgaccucgagccccacaaggugcacguccacuag

SEQ ID NO: 1223 - RNA, 4062 nt, Artificial Sequence; identical to SEQ ID NO: 311
  derived and/or modified CDS sequence (opt11) from MERS-CoV__AGV08455__S

SEQ ID NO: 1224 - RNA, 4062 nt, Artificial Sequence
  derived and/or modified CDS sequence (opt11) from MERS-CoV__AGV08467__S
augauccacagcguguuccugcucauguuccugcuaacccccaccgaguccuaugucgacgugggcccggacagcgugaaguccgccugcaucgaggucgacauccagcagacguucuucgacaagaccuggccccgccccaucgacgugagcaaggccgacggaaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccggcaccgugaucaucucccccaguaccuccgccaccauccggaagaucuaccccgccuucaugcugggcagcagcguugggaacuucagcgacgguaagaugggccgcuucuucaaccacacucucguccugcugccggacgggugcggaacccuccugcgggcguucuacugcauccuggagccccgcuccgggaaccacugccccgccggcaacagcuacaccuccuucgccaccuaccauacgcccgccaccgacugcagcgacggcaacuacaaccggaacgccucccucaauagcuucaaggaauacuucaaccugcgcaacugcaccuucauguacaccuacaacaucacggaggacgagauccuggagugguucgggaucacccagaccgcgcagggcgugcaccuauucagcucccgcuacguggaccuguacgggggcaauauguuucaguucgccacccugccggucuacgacacgaucaaguacuacucaaucaucccccauuccauccgcucaauccagucagaccggaaggccugggccgccuucuacguguacaagcuccagccccugaccuuccugcucgacuuuagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguugagcaggccgagggcguggagugcgacuucagcccgcuccuguccgggaccccgccccaggucuacaacuucaagcgccugguguucaccaacugcaacuacaaccucacgaaguuacugagccucuucuccgucaacgacuucacgugcagccagaucagccccgccgccaucgcguccaacugcuacagcucccugauccuggacuacuuuagcuacccccucuccaugaaguccgaccugagcgugagcuccgccgggcccauuagccaguucaacuacaagcaguccuucagcaacccgaccugccugauccucgccacggugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggauuacuaccgaaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguuugccaacgacaccaaaaucgccagccagcugggcaacugcgucgaauacucccucuacggcgugagcggccgcggcguguuccagaacugcaccgccgucggcgugcgacagcagcgcuucguguacgacgcguaccagaaccuggucggcuacuacuccgacgacggcaacuacuacugccugcgggccugcgugucagugcccguauccguaaucuacgacaaggagacaaagacgcacgccacccuguucgggagcguggccugcgagcauaucuccagcaccaugucccaguacagccgcuccacccgcagcaugcucaagcggcgcgacuccacguacggcccgcugcagacccccgucggaugcgugcugggccucgugaacagcucccuguucgucgaggacugcaagcugccccucgggcaaagccugugcgcccugcccgacaccccgagcacccucacgccccgguccgugcgcagcgugcccggcgagaugagacuggcgucaaucgccuucaaccaccccauccaggucgaccaguugaacagcuccuacuucaagcucagcaucccgaccaacuucuccuucggcgugacgcaggaguacauccagaccacgauccagaaggugaccgucgacugcaagcaguacgugugcaacggauuccagaagugcgagcaacuccugcgcgaguacggccaguucugcagcaagaucaaccaggcccuccacggggccaaccugcggcaggacgacuccguccgcaaccuguucgccagcgucaaguccagccaguccagcccaaucauccccggcuucgggggcgacuucaaccucacccugcuggagcccgugaguaucagcacuggcucccggagcgcgcgcuccgccaucgaggaccuccuguucgacaaggugacgaucgccgacccaggguauaugcagggcuacgacgacugcaugcagcaggggcccgccagcgcccgggaccugaucugcgcgcaguacgucgccggcuacaagguucucccgccccugauggacgugaacauggaggcugccuacaccagcucccugcucgggagcaucgcgggcgucggcuggaccgccgggcuguccagcuucgcagccauacccuucgcccaguccaucuucuaccgccugaacggcguggggaucacccagcagguccucucagagaaccagaagcugaucgcgaauaaguucaaccaggcccugggcgccaugcagacgggguucaccaccaccaaugaggccuuccggaaggugcaggacgccgugaacaacaacgcgcaggcccucuccaagcuggccagcgagcuguccaacacguucggcgccaucagcgccuccaucggcgacaucauucagcgccucgacgugcuggagcaggacgcgcagaucgaccggcugauuaacgggcgccucaccacgcugaacgccuucgucgcccagcagcuggugcggagcgaguccgccgcgcucagcgcccagcuggccaaggacaaggugaacgagugcgucaaggcccaauccaagcgcuccggcuucugcgggcagggcacccacaucguguccuucgucgugaacgcccccaacggccuguacuucaugcacguuggguacuacccaagcaaccacaucgaggucgugucggcguacggccucugcgacgccgccaaccccacgaacugcaucgccccggugaacggguacuucaucaaaaccaacaacacccggaucgucgacgaauggagcuacaccggcagcuccuucuacgcccccgagccgaucacgagccugaacacuaaguacguggcgccccaggugaccuaccagaacaucuccaccaaccugccgccgccccuccuggggaacagcaucggcaucgacuuccaggacgagcuggacgaguucuucaagaacgucuccaccagcauccccaacuucggcucccucacgcagaucaacaccacccugcuggaccucaccuacgagaugcugagccugcagcaggucgugaaggcccucaacgaguccuacaucgacuugaaggagcuggggaacuacacguacuacaacaaguggcccugguacaucuggcucggguucaucgccgggcugguggcccuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 1225 - RNA, 4062 nt, Artificial Sequence
  derived and/or modified CDS sequence (opt11) from MERS-CoV__AGV08492__S
augauccacagcguguuccugcucauguuccugcugacccccaccgaguccuacgucgacgugggcccggacagcgugaaguccgccugcaucgaggucgacauccagcagacguucuucgacaagaccuggccccgcccuaucgacgugagcaaggccgacgggaucaucuacccccaaggccggaccuacuccaacaucaccaucacguaccagggccucuucccguaccagggcgaccacggggacauguacguguacagcgcgggccacgccaccgguaccacgccccagaagcuguucgucgccaacuacucccaggaugugaagcaguucgccaacggguucgugguccgcaucggcgccgcggccaacagcaccgggaccgugaucaucucccccagcaccuccgccacgauccggaagaucuaccccgccuucaugcugggcagcuccguggggaacuucagcgacggcaagaugggccgcuucuucaaccacacgcucguccugcugccggacgggugcggcacccuacugcgggcauucuacugcauccuggagccccgcuccggcaaccacugccccgcgggcaacagcuacacguccuucgccacauaccacacgcccgccaccgacugcucagacggcaacuacaaccggaacgccucccucaacagcuucaaggaguacuuuaaccugcgcaacugcaccuucauguacaccuacaacaucacggaggacgagauccuggagugguucgggaucacccagaccgcgcagggcgugcacuuguucagcucccgguacguggaccuguacgggggcaacauguuccaguucgccacccugccggucuacgacacgaucaaguacuacagcaucaucccccacuccauccgcagcauacagucggaccggaaggccugggcugccuucuacguuuacaagcuccagccccugaccuuccugcucgacuucagcguggacggguacauccgccgggcaaucgacugcggcuucaacgaccugagccaguuacacugcagcuaugaguccuucgacgucgagagcggcguguacuccgugagcuccuucgaggccaagccuagcggguccgucguggagcaggccgagggcguggagugugacuucagcccguuacuguccgggaccccgccccaggucuauaacuucaaacgccugguguucaccaacugcaacuacaaccucacgaagcugcugagccuauuuuccgucaacgacuucacgugcagccagaucucgcccgccgccaucgcguccaacugcuacagcagucugauccucgacuacuucagcuauccccucuccaugaaguccgaccugagcgugagcuccgccgggcccaucagccaauucaacuacaagcaguccuucagcaacccgaccugccugauccucgccaccgugccccacaaccugaccaccaucacuaagccccugaaguacuccuacaucaacaagugcagccggcucuuguccgacgaccgcaccgaggucccccagcuugugaacgccaaccaguauagccccugcguauccaucguccccuccacggugugggaggacggggacuacuaccggaagcagcucagcccgcuggaaggcggcggguggcugguggccuccggcagcaccgucgcgaugaccgaacagcuccagaugggguucggcaucacggugcaguacgggaccgacacgaacuccgugugccccaagcuggaguucgcuaacgacaccaagaucgccagccagcugggcaacugcgucgaguacucccucuacggcgugagcgggcgcggcguguuccagaacugcaccgccgucggcgugcggcaacagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcauguuaaagcggcgcgacuccacguacggcccacugcagacccccgucgggugcgugcugggacuugugaacagcucccuguucgucgaggacugcaagcugccccucgggcagagucugugcgcccugcccgacaccccgagcacccucacgccccgguccgugcgcagcgugcccggcgagaugcggcuggcguccaucgccuucaaccaccccauccagguggaccagcugaacagcuccuacuucaagcucagcaucccgaccaacuucuccuucggcgugacccaggaguacauccagaccacgauccagaaggugacggucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccucggucaaguccagccaguccagccccaucauccccggcuucgggggcgacuucaaccucacccuccuggagcccguguccaucagcaccggcucccggagcgcucgcuccgccaucgaggaccuccuguuugacaaagugacgaucgccgacccgggguacaugcagggcuacgacgacugcaugcagcaggggcccgccagcgcccgggaccugaucugcgcgcaguacgucgccggcuauaaggugcuaccgccccugauggacgugaacauggaggccgccuacaccagcucccugcucgggagcaucgcgggcgucggcuggaccgccgggcucuccagcuucgccgccauccccuucgcccaguccaucuucuaccgucugaacggcguggggaucacccagcagguccucagcgagaaccagaagcugaucgcgaacaaguucaaccaggcccugggcgccaugcagacgggguucaccaccaccaacgaggccuuccggaagguccaggacgccgugaacaacaacgcgcaggcccucuccaagcuggccagcgagcuguccaacaccuucggcgccaucagcgccuccaucggcgacaucauccagcgucucgacgugcuggagcaggacgcgcagaucgaccggcugaucaacgggcgccucaccacccugaacgcuuucgucagccagcagcuggugcgguccgagagcgccgcccucuccgcgcaacuggccaaggacaaggugaacgagugcgucaaggcccagagcaagcgcuccggcuucugcgggcagggcacccacaucgugagcuucgucgugaacgccccaaacggucuguacuucaugcacgugggguacuacccguccaaccacaucgaggucgugagcgccuacggccucugcgacgcggccaaccccacgaacugcaucgcccccgugaacggguacuucaucaaaacaaacaacacccggaucgucgacgaguggucauacaccggauccagcuucuacgcccccgaacccaucacgucccuuaacaccaaguauguggcgccccacgugaccuaccaaaacaucagcaccaaccugccgccgccccuacuggggaacuccaccggcaucgacuuccaggacgagcuggacgaguucuucaagaacgucagcacguccauccccaacuucggcagccucacccagauuaacaccacccugcuggaccucacguacgagaugcugucccugcagcaggucgugaaggcccucaacgagagcuacaucgaccugaaggagcuggggaacuacaccuacuauaacaaguggcccugguacaucuggcucggcuucauugccgggcugguggcccuggcccucugcguuuucuucauccugugcugcaccggcugugggaccaacugcaugggcaaacugaagugcaacagguguugcgaccgcuacgaggaguacgaccucgagccccacaaggugcacguccacuga

SEQ ID NO: 1226 - RNA, 4062 nt, Artificial Sequence
  derived and/or modified CDS sequence (opt11) from MERS-CoV__AGV08584__S
augauccacaguguguuccugcucauguuccuguuaacccccaccgagucuuacgucgacgucggcccggacagcgugaaguccgccugcaucgaggucgacauccagcagaccuucuucgacaagaccuggccccgccccaucgacgugagcaaggccgacgggaucaucuacccgcagggccggaccuacuccaacaucaccaucacguaccagggucucuucccguaccagggcgaccacggggacauguacguguacucggcgggccacgccaccggcaccacgccccagaagcuguucgucgccaacuacucccaggaugugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccuccgggcguucuacuguauccuggagccccgcuccgguaaccacugccccgccggcaacagcuacaccucauucgccaccuaccacacgccagccaccgacugcagcgacggcaauuacaaccggaacgccucccucaacagcuucaaggaguauuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgauaaaguacuacagcaucaucccccacuccauccgcagcauccaguccgaucggaaggccugggccgccuucuacguguacaagcuccagcccuugaccuuccugcucgacuucagcguggacggguacauccgccgggcgaucgacugcgguuucaacgaccugucccagcugcacugcuccuacgaguccuucgacgucgagagcggcgucuacuccgugagcuccuucgaggcuaagcccagcgggucagucguggagcaggccgagggcguggagugcgacuucagcccgcuccuguccgggaccccgccccaggucuacaauuucaagcgccugguguuuaccaacugcaacuacaaccucacgaagcugcugagccucuucuccgucaacgacuucacgugcagccagaucagccccgccgcgaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccacuaucaccaagccccugaaguacuccuacauuaacaagugcagccggcuccuguccgacgaccgcaccgaggucccccagcuggugaacgccaaccaguauagccccugcguguccaucguccccagcacggccugggaggauggggacuacuaccggaagcagcucagcccccuggagggcggcggguggcugguggcguccggaagcaccguggcuaugaccgagcagcuccagaugggcuucggcaucaccguccaguacgggaccgacacgaacucagugugccccaagcuggaguuugccaacgacaccaagauagccagccagcugggcaacugcguggaguacucccucuacggcgucagcgggaggggcguguuccagaacugcaccgcgguggggguccggcagcagcgcuucguuuacgacgccuaccagaaccuggugggcuauuacuccgacgacggcaacuacuacugccugcgggccugcgucagcguacccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggaccgcugcagacccccguggggugcguccugggccucgugaacagcucccuguucguggaggacugcaagcugccccucgggcaaagccugugcgcgcugcccgacaccccgagcacccucacgccccgguccguccgcagcgugcccggcgagaugcggcuggccuccaucgccuucaaccaccccauccagguugaccagcugaacagcuccuacuucaagcucucuaucccgaccaacuucuccuucggcgucacccaggaguacauccagaccacgauccaaaaggugaccguggacugcaagcaguacgucugcaacggguuccagaagugcgagcagcugcugcgcgaguacggccaguucugcagcaaaaucaaccaggcccuccacggggccaaccugcggcaggacgacuccgugcgcaaccuguucgcgagcgugaaguccagccaguccucucccaucauccccggcuucgggggcgacuucaaccucacucugcuggagcccgucuccaucagcaccggcucccggagcgcucgcuccgccaucgaggaccuccuguucgacaaggucacgaucgccgacccgggguacaugcagggcuacgacgacugcaugcagcaggggccugccagcgcgcgggaccugaucugcgcccaguacguggccggcuacaagguccucccgccccugauggacgugaacauggaggccgcguacaccagcucccugcucgggagcaucgccggcgugggcuggaccgccggacuguccagcuucgccgccauccccuucgcgcaguccaucuucuaccgccugaacggcgucgggaucacccagcagguccuuagcgagaaccagaagcugauagccaacaaguucaaccaggcccugggcgccaugcagacgggguucaccaccaccaacgaggccuuccggaaggugcaagacgcggugaacaacaacgcccaggcgcucuccaagcuggccagcgagcuguccaacaccuucggcgccaucagcgcguccaucggcgacaucauacagcgccucgacgugcuggagcaggacgcccagaucgaccggcugaucaacgggcgccucaccacccugaaugccuucguggcccagcagcuggucaggagcgaguccgcggcccucagcgcccagcuggccaaggacaaggugaacgagugcgugaaggcccaguccaagcgcucuggauucugcgggcagggcacccacaucgucuccuucguaguaaacgcgcccaacggccuguacuucaugcacgugggcuacuaccccagcaaccacaucgagguggucuccgccuacggccucugcgacgccgccaaccccacgaacugcauagccccggugaacggguacuucauaaagaccaacaacacacggaucguggacgaguggagcuacaccggcagcuccuucuacgcgcccgagcccaucacgagccugaacaccaaguacgucgcgccccaggugaccuaccagaauaucuccaccaaccugccgccgccccuccuggggaacagcaccggcaucgauuuccaggacgagcuggacgaguucuucaagaacguguccacgagcauccccaacuucggcucccucacccagauuaacaccacccugcuggaccucacuuacgagaugcugucacugcagcaggucgugaaggcccucaacgaguccuacaucgaccugaaggagcuggggaacuacaccuacuacaacaaguggcccugguacaucuggcucggguucaucgccgggcugguggcccuggcccucugcgucuuuuucauccugugcugcaccggcugcgggaccaacugcaugggcaagcugaagugcaaccgcugcugcgaccgcuacgaggaguacgaccucgagccccacaaggugcacgugcacuga

SEQ ID NO: 1227 - RNA, 4062 nt, Artificial Sequence
  derived and/or modified CDS sequence (opt11) from MERS-CoV__AHB33326__S
augauccacuccguguuccugcucauguuccugcugacccccacagaguccuaugucgacgugggcccggauagcgugaaguccgccugcaucgaggucgacauacagcagacguucuucgacaagaccuggccccgccccaucgacgugagcaaggccgacgggaucaucuacccccagggccgaaccuacuccaacaucaccaucacguaccagggccucuucccguaccagggcgaccacggggacauguacguguacagcgcgggccacgccaccggcaccacgccccagaagcuguucgucgccaacuacucccaggacgugaaacaguucgccaacggguucgugguccgcaucggagccgcggccuacagcaccgggaccgugaucaucucccccagcaccuccgccaccauccggaagaucuaccccgccuucaugcuggggagcuccguggggaacuucagcgacggcaagaugggccgcuucuucaaccacacgcucguccuguuaccggacgggugcggaacccuccugcgggcguucuacugcauccuggagccccgcuccgggaaccacugccccgccggcaacagcuacaccuccuucgccaccuaccacacgcccgccaccgauugcagcgacggcaacuacaaccggaacgcaucccucaacagcuucaaggaguacuucaaccugcguaacugcaccuucauguacaccuauaacaucacggaggacgagauccuggagugguucgggaucacccagaccgcgcagggcgugcaccuauucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuuuagcguggacggguacauccgccgggcgaucgacugcgguuucaacgaccugucccagcugcacugcagcuaugaguccuucgacgucgagagcggcguguacuccgugagcuccuucgaggccaagcccagcggguccgucguggagcaggccgagggcguggagugcgacuucucuccgcuccuguccgggaccccgccucaggucuacaacuucaagcggcugguguucaccaacugcaauuacaaccucacgaagcugcugucccucuucuccgucaacgacuucacgugcagccagaucagcccugccgccaucgcguccaacugcuacagcucccugauccuggacuacuuuagcuacccccucuccaugaaguccgaccugagcgugagcuccgccgggcccaucagccaguucaacuacaagcaguccuucagcaacccgaccugccugauccucgccaccguuccccacaaccugaccaccaucaccaagccgcugaaguacuccuacaucaacaagugcagccggcuccuguccgacgaccgcaccgaggucccccagcuggugaacgccaaccaauacagccccugcgugucgaucguccccucuacggugugggaggacggggacuacuaccggaagcagcucagcccccuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacagucuauauggcgugagcgggcgcggaguguuccagaacugcaccgccgucggagugcggcagcagcgcuucguauacgacgccuaccagaaccuggucggcuacuacuccgacgacggcaacuacuacugucuucgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcguccugggccucgugaacagcucccuguucguugaggacugcaagcugccccucgggcagagccugugcgcccugcccgacaccccgagcacccucacgccccggucugugcgcagcgugcccggagagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaaaaucaaccaggcccuccacggggccaaccugcggcaggacgacuccgugcggaaccuguucgccagcgucaaguccagccaguccagccccaucauccccggcuuugggggcgacuuuaaccucacccugcuggagcccguguccaucucgaccggcucccggagcgcgcgcuccgccaucgaagaccuccuguucgacaaggugacgaucgccgacccaggguacaugcagggcuacgacgacugcaugcaccaggggccggccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagugagaaccagaagcugaucgcgaacaaguucaaccaggcccugggagccaugcagacgggguucaccaccaccaacgaggccuuccggaaggugcaggacgccguuaacaacaacgcgcaggcccucuccaagcuggccagcgagcuguccaacacguucggcgccaucagcgccuccaucggcgacauaauccagcgccucgacgugcuggagcaggacgcgcagaucgacaggcugaucaacgggcgccucaccacccuaaacgccuucgucgcccagcagcuggugcggagcgaguccgccgcgcucagcgcccagcuggccaaggacaaggugaacgagugcgucaaggcccaauccaaacgcagcggauucugcgggcagggcacccacaucgucuccuucgucgugaacgcccccaacggccuguacuucaugcacgugggguacuaccccagcaaccacaucgaagucguguccgcguacggccucugcgacgcggccaaccccacgaacugcaucgccccggugaacggguacuucaucaagaccaacaacacccggaucgucgacgaguggagcuacaccggcagcuccuucuacagccccgagcccaucacgucccugaacaccaaguacguggcgccccaggugaccuaccagaacaucagcaccaaccugccgccaccccuccuggggaacuccacuggcaucgacuuccaggacgagcuggacgaguucuucaaaaacgucagcacguccauccccaacuucggcagccucacccagaucaacaccacccugcuggaccucacguacgagaugcugucccugcagcaggucgugaaggcccucaacgagagcuacaucgaccugaaggagcuggggaacuacaccuacuacaacaaguggcccugguacauuuggcucggcuucaucgccgggcugguggcccuggcccucugcguguucuucauccugugcugcaccggcugcgggaccaacugcaugggcaaguuaaagugcaaccgcugcugcgaccgcuacgaggaguacgaccucgagccccacaaggugcauguccacuga

SEQ ID NO: 1228 - RNA, 4062 nt, Artificial Sequence; identical to SEQ ID NO: 316
  derived and/or modified CDS sequence (opt11) from MERS-CoV__AHC74088__S

SEQ ID NO: 1229 - RNA, 4062 nt, Artificial Sequence; identical to SEQ ID NO: 317
  derived and/or modified CDS sequence (opt11) from MERS-CoV__AHI48528__S

SEQ ID NO: 1230 - RNA, 4062 nt, Artificial Sequence
  derived and/or modified CDS sequence (opt11) from MERS-CoV__AHI48550__S
augauccacagcguauuccugcucauguuccugcugacucccaccgaguccuacgucgacguaggcccggacagcgugaaguccgccugcaucgaggucgacauccagcagacauucuucgacaagaccuggccccgccccaucgacgugagcaaggcggacgggaucaucuauccccagggccggaccuacagcaacaucaccaucacguaccagggccuguucccguaccagggagaccacggggacauguacguguacagcgcgggccaugccaccggcaccacgccccagaagcuguucgucgccaacuacucccaggacgugaaacaauucgccaacggauuugugguccgcaucggcgcagcggccaacagcaccgggaccgugaucauaucccccagcaccuccgcaaccauccggaagaucuaccccgccuucaugcuugguagcagcguggggaauuuuagugacggcaagaugggccgcuucuucaaccacacgcucguccugcugccggacgggugcggcacccuccuacgggcguucuauugcauucuggagccccgcuccgggaaccacugccccgccggcaacagcuacacauccuucgcuaccuaccacacucccgccaccgacuguagcgacggcaacuacaaccgcaacgccucccucaacucauucaaggaguacuucaaccugcgcaacugcaccuucauguacaccuacaacaucacggaggacgagauccuggagugguucgggaucacccagaccgcgcagggcgugcaccucuucagcucucgguacguggaccuguacgggggcaacauguuccaguucgcaacccugccggucuacgacacgaucaaguacuacagcaucauaccgcacuccauccgcagcauucaguccgaccggaaggccugggccgccuucuacguguacaaacuccaaccccugaccuuccugcucgacuucagcguggacggguacauccgccgggcgaucgacugcggcuucaacgaccugucccagcugcacugcagcuacgaguccuucgacgucgagagcggcguguauuccgugucguccuucgaggccaagcccagcggguccgucguagagcaagccgagggcguggagugcgacuucagcccgcuccuguccgggaccccgccucaggucuacaacuucaaacgccugguguucaccaacugcaacuacaaccucacgaagcugcugagccucuucuccgucaacgacuucacgugcagccagaucagccccgccgccaucgcgucgaacugcuacagcuccuuaauccuggacuacuucuccuauccccucuccaugaaauccgaccuguccgugagcuccgccggccccaucucccaguucaacuacaagcaguccuucagcaacccgaccugccugauacucgccaccgugccccacaaccugaccaccaucaccaagccccugaaguacuccuacaucaacaagugcucccgacucuuguccgacgaccgcaccgaagucccccagcuggugaacgccaaccaguacuccccuugcguguccaucguccccagcacgguuugggaggacggggacuacuaccggaagcagcucagcccgcuggagggcggaggguggcugguggccaguggcagcaccgucgcgaugaccgagcaguuacagaugggguucggcauaaccgugcaguacgggaccgacacgaacuccgucugccccaagcuggaguucgccaacgacacaaagaucgccagccagcugggaaacugcgucgaguacucccucuacggcguaucggggcgcggaguguuccagaacuguaccgccguuggggugcggcaacagcgcuucguguacgacgcguaccagaaccuggucggcuacuacuccgacgacggcaacuacuacugccuucgggccugcgucucagugcccgucuccgugaucuacgacaaggagaccaaaacgcacgccacccuguuugggagcgucgccugcgagcacauuuccagcaccaugagucaguacagccgcuccacacgcagcaugcucaagcggcgcgacuccacguacggcccgcugcagacccccguagggugcgugcuaggccucgugaacagcucccuguucgucgaggacugcaagcugccccucgggcagucccugugcgcccuucccgacacgccgagcacccugacgcccagguccgugcgcagcgugcccggcgagaugcggcuggcgucuaucgcauucaaccacccuauccaggucgaccagcugaacagcuccuacuucaagcucagcaucccgaccaacuucuccuuuggcgugacccaggaguacauccagaccacgauccaaaaagugaccgucgacugcaagcaguacgugugcaacggguuccagaaaugcgagcagcugcugagggaguacggccaguucugcagcaagauaaaccaggccuuacacggggccaaccugcggcaggacgacuccgugcgcaaccuguucgcgagcgucaagaguagccaguccagccccaucauccccggcuucgggggcgacuucaaccucacccugcuggagcccguguccaucagcaccggcucccggagcgcgcgcuccgcaaucgaggaccuccuguucgacaagguaacgaucgccgacccgggguacaugcagggcuacgacgacugcaugcagcaggggcccgcaagugcccgggacuuaaucugcgcucaauacgucgccggcuacaagguguuaccgccccugauggacgucaacauggaggcggccuacaccagcucccugcucgggagcaucgcgggcgucggcuggaccgccggguuguccagcuucgccgccauccccuucgcccaguccaucuucuaccgccugaacggcguugggaucacccagcagguccucagcgagaaccagaagcugaucgcgaacaaguucaaccaggcccucggcgccaugcaaacaggguucacgaccacgaacgaggccuuccauaaggugcaggacgccgugaacaacaacgcgcaggcucucuccaaacuggccagcgagcuguccaacacguucggcgccaucagcgccuccaucggcgacaucauccagcggcucgacgugcuggagcaagacgcgcagaucgaccgccugaucaacgggaggcucaccacccugaacgccuucgucgcccagcagcuggugcgcagcgaguccgccgcucucagcgcccagcuggccaaggacaaggugaacgagugcgucaaggcucaauccaagcggucuggcuucugcgggcagggcacccacaucguguccuucgucguaaacgcccccaacggcuuguacuucaugcacguggguuauuaccccagcaaccacauagaggucguguccgcguacggccugugcgaugccgccaaccccacgaacugcaucgccccgguuaacggguauuucaucaagaccaacaacacacgcaucgucgacgaguggagcuacacagggucuuccuucuacgcccccgagcccaucacgagccugaacaccaaguacguggcgccccaggucaccuaucagaacaucuccaccaaccugccgccgccccuccugggcaacagcaccggcaucgacuuccaggacgagcuggacgaguucuucaagaaugucuccacgagcaucccaaacuucggcucccucacccagauaaacacgacccugcuggaccucacguacgagaugcugagccuucagcaagucgucaaggcucucaacgaguccuacaucgaccugaaggagcuggggaacuacaccuacuacaauaaguggcccugguacaucuggcucggcuucaucgccgggcugguggcccuggcccugugcguguucuucauccugugcugcaccggcugcgggaccaacugcaugggcaagcugaagugcaaccgaugcugcgaccgcuacgaggaguacgaccuccagccccacaaagugcacguccacuga

SEQ ID NO: 1231 - RNA, 4062 nt, Artificial Sequence
  derived and/or modified CDS sequence (opt11) from MERS-CoV__AHI48583__S
augauccacagcguguuucugcucauguuccugcugacccccaccgaguccuacgucgacgugggcccggacagcgugaaguccgccugcaucgaggucgacauccagcagacguucuucgacaagaccuggccccgccccaucgacguguucaaggccgacgggaucaucuacccccagggccggaccuacagcaacaucaccaucacguaccagggccucuucccguaccagggcgaccacggagauauguacguguacuccgcgggccacgccaccggcaccacgccccagaagcuguucgucgccaacuacagccaggacgugaagcaguucgccaacgguuucguggucaggaucggcgccgcggccaacuccaccgggaccgugaucaucagccccucgaccagcgccaccaucagaaagaucuaccccgccuucaugcugggguccagcguggguaacuucuccgacggcaagaugggccgcuucuucaaccacacgcucguucugcugccggacgggugcggaacccuccugcgggcguucuacugcauccuggagccccgcagcgggaaccacugccccgccggcaacuccuacaccagcuucgccacuuaccacacgcccgccaccgacugcuccgacggcaacuacaaccggaacgccagccucaacuccuucaaggaguacuucaaccugcgcaacugcaccuuuauguacaccuacaacaucaccgaggacgagauccuggagugguucgggaucacccagaccgcgcagggcgugcaccucuucagcagccgguauguggaccuguacggggguaacauguuccaguucgccacccugccagucuacgacacgaucaaguacuacuccaucaucccccacagcauccgcuccauccagagcgaccggaaggccugggcggccuucuacguguacaagcuccagccccugaccuuccugcucgacuucucgguggauggguacauccgccgggcgaucgacuguggcuucaacgaccugagccagcugcacugcuccuacgagagcuucgacgucgaguccggcguguauagcguguccagcuuugaggccaagcccuccgggagcgucguggagcaggcagagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgucgaacugcuacuccagccugauccuggacuacuucuccuacccccucagcaugaaguccgaccugagcguguccagcgccgggcccaucucccaguucaacuacaagcagucauucuccaacccgaccugccugauccucgccacggugccccacaaccugaccaccaucaccaagccccugaaguacagcuacauuaacaagugcucccggcuccugagcgacgaccgcaccgaggucccccagcuggugaacgccaaccaguacucucccugcgugagcaucguccccaguacggugugggaggacggggacuacuaccggaagcagcucagcccacucgagggcggcggguggcugguggccucgggcuccaccgucgcgaugaccgaacagcuccagaugggguucggcaucaccgugcaguacgggaccgauacgaacagcgugugccccaagcuggaguucgccaacgacaccaagaucgccucccagcugggcaacugcguagaguauagccucuacggcguguccgggcgcggcguguuccagaacugcaccgccgucggggugcggcagcagcgcuucguguacgacgcauaccagaaccuggucggcuacuacagcgacgacggcaacuacuacugccuuagggccugcguguccgugcccgucagcgugaucuacgacaaggagaccaagacucacgccacccuguucggguccguggccugcgagcacaucagcuccaccaugagccaguacucccgcagcacccgcuccaugcucaagcggcgcgacagcacguacggaccccugcagaccccugucgggugcgugcugggccucgugaacuccagccuguucgucgaggacugcaagcugccccucgggcagagucugugcgcccugcccgacaccccgagcacccucacuccccggagcgugcgcuccgugcccggcgagaugcggcuggcgagcaucgccuucaaccaccccauucaagucgaccagcugaacagcagcuacuucaagcucuccaucccgaccaacuucagcuucggcgugacccaggaguacauccagaccaccauccagaaggugaccgucgacugcaagcaguacguaugcaacggguuccagaagugcgagcagcugcugcgcgaguacggccaguucugcuccaagaucaaccaggcccuccacggggccaaccugcggcaagacgacagcgugcgcaaccuguucgccucaguaaagagcucccagagcucccccaucauucccggcuucgggggcgacuucaaccucacccugcuggagcccgugagcaucuccaccggcagccgguccgcgcgcagcgccaucgaggaccuccuguucgacaaggugacgauugccgacccgggguacaugcagggcuacgacgacugcaugcagcaggggcccgccuccgcacgggaccucaucugcgcgcaguacgucgccggcuacaaggugcucccgccccugauggacgugaacauggaggccgccuacaccagcagccugcucggguccauagcgggcguuggcuggaccgcggggcuguccuccuucgccgcuauccccuucgcucagagcaucuucuaccgccugaacggcguggggaucacgcagcagguccucuccgagaaccagaagcugaucgcgaacaaguucaaccaggcccugggcgcuaugcagacgggguuuaccaccaccaacgaggccuuccacaagguacaggacgccgugaacaacaacgcgcaggcccucagcaagcuggccuccgagcugagcaacacguucggcgccaucuccgccagcaucggcgacaucauucagcggcucgacgugcuggagcaggacgcgcagaucgaccgccugaucaacgggcggcucaccacccugaacgccuucgucgcccagcagcuggugcgcuccgagagcgccgcgcucuccgcccagcuggccaaggacaaagugaacgaaugcgucaaggcccagucuaagcgguccggcuucugcgggcagggcacccacaucgugagcuucgucgucaacgcccccaacggccuguacuucaugcacgugggguacuaccccuccaaccacaucgaggucgugagcgcguacggccucugcgacgccgccaaccccacgaauugcaucgccccggugaacggguacuucaucaaaaccaacaacaccagaauugucgacgaguggagcuacaccggcagcagcuucuacgcccccgagcccaucacgucccugaacaccaaguacguggcgccccaggugacauaccagaacaucagcaccaaccugccgccgccccuccuggggaacuccaccggcaucgacuuccaggacgagcuggacgaguucuuuaagaacgucagcacguccauccccaacuucggcagccucacccagaucaacaccacccugcuggaccucacguacgagaugcugucccuucagcaagucgugaaggcccucaacgagagcuacaucgaccugaaagagcuggggaacuacaccuacuacaacaaguggcccugguacaucuggcucggauucaucgcagggcugguggcccuggcucucugcguguucuuuauccugugcugcaccgggugcgggaccaacugcaugggcaagcugaagugcaaucgaugcugcgaccgcuacgaggaguacgaccucgagccccacaaggugcacguccacuga

SEQ ID NO: 1232 - RNA, 4062 nt, Artificial Sequence
  derived and/or modified CDS sequence (opt11) from MERS-CoV__AHI48605__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguaagcaaggccgacgggaucaucuacccccagggccggaccuacuccaacaucacgaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcugccaacagcaccgggaccgugaucaucucccccagcaccuccgcuaccauccggaagaucuaccccgccuucaugcugggcagcuccguggggaacuucucugacggcaagaugggccgcuucuucaaccacacgcucguccugcugccggacggguguggcacucuccugcgggcguucuacuguauccuggagccccgcuccgggaaccacugccccgccggcaacagcuacaccuccuucgccaccuaccacacgcccgccaccgacugcagcgacggcaacuacaaccggaacgccucccucaacuccuucaaggaguacuucaaccugcgcaacugcaccuucauguacaccuacaacauaacggaggacgagauccuggagugguucgggaucacccagacggcgcagggcgugcaccucuucuccucccgguacguggaccuguacgggggcaacauguuccaguucgccacccugccggucuacgacacgauuaaguacuacagcaucaucccccacuccauccgcagcauccaguccgaccggaaggccugggccgccuucuacguguacaagcuccaaccucugacguuccugcucgacuucagcguggacggguacauccgacgggcgaucgacugcggcuucaacgaccuaucccagcugcacugcagcuacgaguccuucgacguagaaucaggcguguacuccgugagcuccuucgaggccaagcccagugggagugucguggagcaggccgagggcguggagugcgacuucagcccgcuccuguccgggaccccgccccaggucuacaacuucaagcgccuggucuucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggccgaucagccaguucaacuacaagcaguccuucagcaacccgaccugccugauccucgcaaccgugccccacaaccugaccaccaucaccaagccccugaaguacuccuauaucaacaagugcagccggcuccuguccgacgaucgcaccgaggucccccagcuggugaacgccaaccaguacagccccugcguguccaucguccccagcacggugugggaagacggggacuauuaccggaagcagcucagcccgcuggaaggcggcggguggcugguggccuccggcagcaccgucgcgaugaccgagcagcuccagaugggcuucggcaucaccgugcaguacgggaccgauacgaacuccguaugccccaagcuggaguucgccaacgacacuaagaucgccagccagcugggcaacugcguagaguacucccucuacggcgugagcgggagaggcguguuccagaacugcaccgccgucggggugcggcagcagcgcuuuguguacgacgcguaccagaaccuggucggcuacuacuccgacgacggcaacuacuacugccugcgggccugcgugagcgugcccgucuccgugaucuacgacaaggagaccaagacgcacgccacccuguucgggucuguggcaugcgagcacauauccagcaccaugucccaguacagccgcucaacccgcucgaugcucaagcggcgcgacuccacguacggcccgcuucagacccccgucgggugcgugcugggccucgugaacagcucccuguucgucgaggacugcaagcugccccucggccagagccugugcgcccugcccgacaccccgagcacccucacgccccgguccgugcgcagcgugcccggcgagaugcggcuggcguccaucgccuuuaaccaccccauccaggucgaccagcugaacagcuccuacuucaagcucagcaucccgaccaauuucuccuucggcgugacccaggaguacauccagaccacgauccagaaggugacagucgacugcaagcaguacgugugcaacggguuccagaagugcgagcagcugcuucgcgaguacggccaguucugcagcaagaucaaccaggcuuugcacggggcgaaccugcggcaggacgacucggugcgcaaccuguucgccucggucaaguccagccaguccagcccaaucauccccgguuucgggggcgacuucaaccucacccugcuggagcccguguccaucagcaccggcucacggucugcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaagguccucccgccccugauggacgugaacauggaggccgccuacaccagcucccugcucgggagcaucgcgggcgucggcuggaccgccgggcuguccagcuucgccgccauccccuuugcccaguccaucuucuaccgccugaacggcguggggaucacccagcagguccucagcgaaaaccagaagcugaucgcgaacaaguucaaccaggcccugggcgccaugcagacgggguucaccaccaccaacgaggcguuccacaaggugcaggacgccgugaacaacaacgcgcaggcccucuccaagcuggccagugagcuuuccaacacuuucggcgccaucagcgccuccaucggcgacaucauccagagacucgacgugcuggagcaggacgcgcagaucgaccgccuuaucaacgggcggcucaccacccugaacgccuucgucgcccagcagcuggugcgcagcgaguccgccgcgcucagcgcccagcuggccaaggacaaggugaacgaaugcgugaaggcccaguccaagcggagcggcuucugcgggcagggcacccacaucguguccuucgucgugaacgcccccaacggccuguacuucaugcacgugggguacuaucccagcaaccacaucgaggucguguccgcguacggucucugcgaugccgccaaccccacgaauugcaucgccccugugaacggguacuucaucaagaccaacaacacccgcaucgucgacgaguggagcuacaccggcagcuccuucuacgcccccgagcccaucacgagccucaacaccaaguacguggcgccccaagugaccuaccagaacaucuccaccaaccugccgccgccucuccuggggaacagcaccggcaucgacuuccaggacgagcuggacgaguucuucaagaacguauccacgagcauccccaacuucggcucccucacccagaucaacaccacccugcuggaccucacguacgagaugcugagccugcagcaggucgugaaggcccucaacgaguccuacaucgaccugaaggagcugggaaacuacaccuacuacaacaaguggcccugguacaucuggcucggcuucaucgccgggcugguugcccuggcccucugcguuuucuucauccugugcugcaccggcugcgggaccaacugcauggggaaguugaaaugcaaccggugcugcgaccgcuacgaggaguacgaccucgagccccacaaggugcacguccacuga

SEQ ID NO: 1233 - RNA, 4062 nt, Artificial Sequence
  derived and/or modified CDS sequence (opt11) from MERS-CoV__AHY21469__S
augauccacagcguguucuuacucauguuccugcugacccccaccgaauccuacgucgacgucggcccggacagcgugaaguccgccugcaucgaggucgacauucagcagacuuucuuugauaagaccuggccucgcccaauagacgugaguaaggccgacgggaucaucuacccccagggccggaccuauuccaacaucacuaucacguaccagggccucuuccccuaccagggcgaccauggggacauguacguguacagcgcggggcacgccaccgucaccacgccccagaaacucuucgucgccaacuauucacaggaugugaagcaguucgccaacggcuucgucgugcgcaucggcgccgcggccaacagcaccgggaccgucaucaucucccccagcaccagcgccaccauacggaagauuuaccccgcuuucaugcugggaucguccgugggcaacuucagcgacgggaagaugggccgcuucuucaaccacacguuagugcugcugccggacggcugcgggacccuucugcgggcauucuacugcauccuggagccccgcucgggcaacuacugccccgccgggaacucauacaccuccuucgccaccuaccacacgcccgcaaccgacuguagcgacggcaacuacaaccggaacgccucccucaacagcuucaaggaguacuucaaucugcgcaacugcaccuucauguauaccuacaacaucacggaggacgagauccuggagugguucggcaucacccagaccgcccagggggugcaccucuuuagcuccagauacgucgaccuguacggcggaaacauguuccaguucgccaccuugccggucuacgacacgaucaaguacuacagcaucaucccccacagcauccucagcauccagucggaccgcaaggccugggcggccuuuuacgucuacaagcugcagccccugacguuccuccuggacuucagcgucgacggcuacauccgcagagcgauugacugcggguucaaugaccugucccaguugcacugcagcuacgaguccuucgacgucgagagcggcguguacuccgugagcuccuucgaggccaagcccagcggcucggugguggagcaggccgagggggucgagugcgacuuuagcccgcugcuguccgguaccccgccccagguuuauaacuucaagcggcucgucuucaccaauugcaacuacaaccugacaaagcugcucagccuguuuuccgugaacgacuucacgugcagccagauuagccccgccgccaucgcgucuaacuguuacagcucccugauccucgacuacuucagcuauccucuguccaugaaguccgaccugagcgugucuucugccgggcccauuagccaguucaacuacaagcaguccuucucgaacccgaccugccucaucuuagccaccgucccccacaaccugaccaccaucacuaagccgcuuaaguacucuuacaucaacaagugcucgcgccuguuguccgacgacaggaccgaagugccccaacucgugaacgccaaccaguacagccccugcgucuccaucguccccagcacggugugggaggacggugauuacuaccgcaagcagcugagcccgcuggaaggcgggggcuggcucgucgcauccgggagcaccguggcgaugaccgagcagcugcagaugggcuucggaaucacugugcaguacgguaccgacaccaacuccgucugcccaaagcucgaguucgccaacgacaccaagaucgccagccagcucgggaacugcguggaguacucccuuuacggcgugagcggcagaggggucuuccagaauugcaccgccgugggcgugcggcagcagagguucgucuaugacgcguaccagaaccuggugggcuauuacuccgacgacggcaacuacuacugccugcgcgcuugcguaaguguccccguguccgucauuuacgacaaggagaccaagacacaugccacccucuucggcagcguugccugcgagcacaucuccagcaccaugucccaguacucgcgguccacccgcagcauguuaaagcgccgugacuccacuuacgggccccugcagacccccgugggaugcguguuagggcuggugaacagcucccuguucguggaggacugcaaacucccccugggccagagcuuaugcgcccuccccgacaccccaagcacccuaacgccccgguccgugcggucaguccccggggagaugcgccuagcguccaucgcauucaaccaccccauccagguggaucagcucaacucuucuuauuucaagcuaagcauaccgaccaacuucuccuucggugugacccaggaguacauccagaccaccauccaaaaagucaccguggauuguaagcaguaugugugcaacggcuuccaaaagugcgaacagcugcuccgggaguacgggcaguucugcucuaagaucaaucaagcccugcacggcgccaaccugcgccaggacgacuccguccggaaccucuucgcuucggugaaguccagccaguccagccccaucauccccggguucggcggggacuucaacuugaccuuacucgagcccgugucaaccagcacuggcagccgcagcgcgcgguccgccaucgaggaccugcuguucgacaagguaaccaucgccgacccggguuacaugcagggguacgacgauugcaugcagcaggguccugccagugcccgcgaccugaucugugcccaguauguggccggguacaagguacugccgccccuaauggacgucaacauggaggccgcauacacaagcucccuccugggcagcaucgcgggggugggcuggacugccggcuuauccagcuucgccgccauccccuuugcccaguccaucuuuuaccggcucaacggggugggcaucacgcagcaaguucugagcgagaaccagaagcugaucgccaacaaguucaaccaggcccucggggccaugcagaccggcuucaccaccacgaacgaggccuuccagaaggugcaggacgccgugaacaacaacgcgcaggcccuguccaagcuggcaagcgagcucucuaacaccuucggggcaaucagcgccuccaucggcgacaucauccagcgccuggauguccuggaacaagacgcgcagaucgaccgauuaaucaacggccgccugaccacccugaacgccuucguggcccagcagcucgugcggagugaguccgccgcgcugagcgcccagcuggccaaggacaaggucaacgagugcguaaaggcccaguccaaacgcagcggguucuguggccaggggacacacauugucucuuucguggugaacgccccgaacggacuguacuucaugcacgucggcuacuaccccagcaaccacaucgaggugguguccgcguacgggcugugcgacagcgccaacccaaccaacugcaucgccccggucaacggcuauuucaucaagaccaacaacaccaggaucguggacgaguggagcuacacgggauccucauucuacgcccccgaacccaucaccucacugaauaccaaauacguugcgccccaggucaccuaccagaacaucagcaccaaccuaccgccgccccuccugggcaacuccacgggaaucgacuuccaagacgagcucgacgaguucuucaagaacgugagcaccuccauccccaacuucggcagccugacccagaucaacaccacgcugcucgaccugaccuaugagaugcugucccuucaacagguggucaaggcccugaacgagagcuacaucgaccugaaagaguuagggaacuacaccuacuauaacaaguggcccugguacaucuggcugggcuucaucgcaggccugguggcccucgcucuguguguguucuucauccugugcugcaccggcugcgguacgaacugcauggggaagcucaagugcaaccgcugcugcgaccgguacgaagaauacgaccuggagccucacaagguccacgugcacuag

SEQ ID NO: 1234 - RNA, 4062 nt, Artificial Sequence
  derived and/or modified CDS sequence (opt11) from MERS-CoV__AHZ64057__S
augauccauagcguguuccugcucauguuccugcugacccccaccgaguccuacgucgacgugggcccggacagcgugaaguccgccuguaucgaggucgacauccagcagacguucuucgacaagaccuggccccgccccaucgacgugagcaaggccgacgggaucaucuacccccagggccguaccuacuccaacaucaccaucacauaccagggccucuucccguaccagggcgaccacggggacauguacguguacagcgcgggccacgccaccggcaccacgccccagaaacuguucgucgccaauuacucccaggacgugaagcaguucgccaacggguucguaguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacacucguccugcugccggacgggugcgguacccuccugcgggcguucuacugcauccuggagccccgcuccgggaaccacugccccgccggcaacagcuacaccuccuucgccaccuaccacacgcccgccaccgacugcagcgacggcaacuauaaucggaacgccucccucaauagcuucaaagaguacuucaaccugcgcaacugcaccuucauguacaccuacaacaucacggaggacgagauccuggagugguucgggaucacccagaccgcgcagggcgugcaccucuucagcucccgguacguggaccuguaugggggcaacauguuccaguucgccacccugccggucuacgacacgauuaaguacuacagcaucaucccccacuccauccgcaguauccaguccgaccggaaggccugggccgccuucuacguguacaagcuccagccgcugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagccaagcggguccgucguggagcaggccgagggcguggagugcgacuucagcccgcuccuguccgggaccccgccccaggucuacaacuucaagcgccugguguucaccaacugcaacuacaaccucacgaagcuacugagccucuucuccgucaacgacuucacgugcagccagaucucacccgccgccaucgcguccaauugcuacagcuccuuaauccuggacuacuucucauacccccucuccaugaaguccgaccugagcgugagcuccgccgggcccauaucgcaguucaacuacaagcaguccuucucuaacccgaccugccugauccucgccaccgugccccacaaccugaccacaaucaccaagccccugaaguacuccuacaucaacaagugcagccggcuccucuccgacgaccgcaccgaggucccccagcuggucaacgcgaaccaguacagccccugcguguccaucguccccagcaccgugugggaggacggggacuacuaccggaagcagcucucaccgcuggaaggcggcggguggcugguggccuccggcagcaccgucgcgaugacugagcagcuccagaugggauucggcauuaccgugcaauacgggaccgacacgaacuccgugugccccaagcuggaguucgccaacgacaccaagauagccagccagcucggcaacugcguggaguacucucucuacggcgugagcgggcgcggcguuuuccagaacugcaccgccgucggggugcggcagcagcgcuucguguacgacgcguaucaaaaccuggucggcuacuacuccgacgacggcaacuacuacugccugcgggccugcgugagcgugccggucuccguaaucuacgacaaggaaaccaagacgcacgccacccuguucgggagcguggccugcgagcacaucuucuccaccaugagccaguacagucgcagcaccagguccaugcucaagcgucgugacagcacguacggcccgcugcagacccccgucgggugcgugcugggccucgugaacuccagccuguucgucgaggacuguaagcucccccucgggcagucccugugcgcccugcccgacaccccaagcacgcucacgccccggagcgugcgcucggugcccggcgagaugcggcuggcgagcaucgccuucaaccaccccauccaagucgaccagcugaacuccagcuacuucaaguuauccaucccgaccaacuucagcuucggcgugacccaggaguacauccagaccacgauccagaaggugaccgucgacugcaagcaauacgugugcaacggguuccagaagugcgagcagcugcugcgcgaguacggccaguucugcuccaaaaucaaccgcgcccuccacggggccaaucugcgccaggacgacagcgugcggaaccuguucgccucagucaagagcagccagagcucccccauuauccccggcuucgggggcgacuucaauuuaacucugcuggagcccgugagcaucuccaccggcagccgcuccgcgcggagcgccaucgaggaccuccuguucgacaaagugacgauagcggacccgggguacaugcaaggcuacgacgacugcaugcagcaggggcccgccuccgcccgcgaccugaucugcgcgcaguacgucgccggcuacaaggugcucccaccccugauggacgugaacauggaggccgccuacaccagcagccugcucggguccaucgcgggcgucggcuggaccgccgggcugagcuccuucgccgccauccccuucgcccagagcaucuucuaccggcugaacggcguggggaucacccagcagguccucuccgagaaccagaagcugaucgcgaacaaguucaaccaggcccugggcgccaugcagacgggguucaccaccaccaacgaggccuuccgcaaggugcaagacgccguaaauaacaacgcgcaggcccucagcaagcuggccuccgagcugagcaacacguucggagccauauccgccagcaucggcgacaucauccagcggcucgacgugcuggagcaggacgcgcagaucgaccgccugaucaacgggcggcucaccacccugaacgccuucgucgcccagcagcugguccgcuccgagagcgccgcgcucuccgcccagcuggccaaggacaaggugaacgagugcgucaaggcccagagcaagcgguccggcuucugcgggcaaggcacgcacaucgugucuuucgucgugaacgcccccaacggccuguacuucaugcacgugggguacuaccccuccaaccacaucgaggucgugagcgcguacggccucugcgacgccgccaaccccacgaacugcaucgccccggugaacggguacuucaucaagaccaauaacacccgcaucgucgacgaaugguccuacaccggcagcucguucuacgcacccgagcccaucacgucccugaacaccaaguacguggcgccccaggucaccuaccagaacaucagcaccaaccugccgccgccccuccuggggaacuccaccggcaucgacuuccaggaugagcuggacgaguucuucaagaacgucagcacguccauccccaacuucggcagccucacccagaucaacaccacccugcuggaccucacguacgagaugcugucccuacagcaggucgugaaggcccuuaacgagagcuacaucgaccugaaggagcuggggaacuacaccuacuacaacaaguggcccugguacaucuggcucggcuucaucgccgggcugguggcccuggcccucugcguguucuucauucugugcugcaccggcugcggcaccaacugcaugggcaagcugaagugcaaccgcugcugcgaucgguacgaggaguacgaccucgagccccacaaggugcacguccacuga

SEQ ID NO: 1235 - RNA, 4062 nt, Artificial Sequence; identical to SEQ ID NO: 323
  derived and/or modified CDS sequence (opt11) from MERS-CoV__AID50418__S

SEQ ID NO: 1236 - RNA, 4062 nt, Artificial Sequence; identical to SEQ ID NO: 324
  derived and/or modified CDS sequence (opt11) from MERS-CoV__AID55068__S

SEQ ID NO: 1237 - RNA, 4062 nt, Artificial Sequence; identical to SEQ ID NO: 325
  derived and/or modified CDS sequence (opt11) from MERS-CoV__AID55073__S

SEQ ID NO: 1238 - RNA, 4062 nt, Artificial Sequence
  derived and/or modified CDS sequence (opt11) from MERS-CoV__AIY60528__S
augauacacagcguguuccugcucauguuccugcugacccccaccgaguccuacgucgacgugggcccggacagcuucaaauccgccugcaucgagguggacauucagcagacguucuucgacaaaaccuggccacgccccaucgaugucagcaaggcugacgggaucaucuacccccagggccggaccuacuccaacaucaccaucacguaccagggccucuucccguaccagggcgaccacggggacauguacguguacagcgcgggccacgccaccggcaccacgccccaaaagcuguucguggccaacuacucccagaacgucaagcaguucgccaacggguucguggugcgcaucggcgccgcggccaacagcaccgggaccguuaucaucucccccagcaccuccgccaccauccggaagaucuaccccgccuucaugcugggcagcuccguggggaacuucagcgacggcaagaugggccgcuucuucaaccacacgcucgugcugcugcccgacgggugcggcacccuccugcgggcguuuuacugcauccuggagccccgcuccgggaaccacugccccgccggcaacagcuacaccuccuucgccaccuaccauacgcccgcgaccgacugcagcgacggcaacuacaaccggaacgccucccucaacagcuucaaggaguacuucaaccugcgcaacugcaccuucauguacaccuacaauaucacggaggacgagauccuggagugguucgggauuacccagaccgcgcagggcguccaccucuucagcucccgguacguggaccuguacgggggcaacauguuccaguucgccacccugccgguguaugacacgaucaaguacuacagcaucaucccccacuccauccgcagcauccaguccgaccggaaggccugggccgccuucuacgucuacaagcuccagccccugaccuuccugcucgacuucagcguggacggguacaucaggcgggcgaucgacugcggcuucaacgaccugucccagcugcacugcagcuacgaguccuuugacguugagagcggugucuacuccgugagcuccuucgaggccaagcccagcggguccgucguugagcaagccgagggcguggagugcgacuucagcccgcuccuguccgggaccccgccccagguguacaacuucaagcgccuggucuucaccaacugcaacuacaaccucacgaagcuguugagccucuucuccgugaacgacuucacgugcagccagaucagccccgccgccaucgcguccaacugcuacagcucccugauccuggacuacuucagcuacccgcucuccaugaaguccgaccugagcgucagcuccgccgggcccaucagccaguucaacuacaagcaguccuucagcaacccgaccugccugauccucgccacggugccccacaaccugaccaccaucaccaagccccugaaguauuccuacaucaacaagugcagccggcuccugucggacgaccgcaccgaggugccccaguuggucaacgcaaaccaguacagccccugcguguccaucgugcccagcacggucugggaggacggggacuacuaucggaagcagcucagcccgcuggagggcggcggauggcugguggccuccggcagcaccguggcgaugaccgagcagcuccagaugggguucggcaucaccguccaguacgggacggacacgaacuccgugugccccaagcuggaguucgccaacgacaccaagaucgcaagccagcugggcaacugcguggaauacucccucuacggcgucagcgggcgcggcguguuccaaaacugcaccgccguggggguccggcagcagcgauucguguacgacgcguaccagaaccuggugggcuacuacuccgacgacggaaacuacuacugccugcgggccugcgucagcguucccguguccgucaucuacgacaaggagaccaagacgcacgccacccuguucgggucgguggccugcgagcacaucucaagcaccaugucccaguacagccgcuccacccgcagcaugcucaagcggcgcgacuccacguacggcccgcugcagaccccaguagggugcguccugggccucgugaacagcucccuguucguggaggacugcaagcugccccucgggcagagccugugcgcccugcccgacaccccaagcacccucacucccagguccguccgcagcgugcccggcgagaugcggcuggcguccaucgccuucaaccaccccauccagguggaccagcugaacagcuccuacuucaagcucagcaucccgaccaacuucuccuucggcgucacacaggaguacauccagaccacgauccagaaggugaccguggacuguaagcaguacgucugcaacggguuccagaagugcgagcagcugcugcgcgaguacggccaguucugcagcaagaucaaccaagcccuccacggggccaaccuacggcaggacgacuccgugcgcaaccuguucgccucagucaaguccagccaguccagccccaucauccccggcuucggcggcgauuucaaccucacccugcuggagcccgucucuaucagcaccgggucccggagcgcgcgcuccgccaucgaggaccuccuguucgacaaggugacaaucgccgacccgggguacaugcagggcuacgacgacugcaugcagcaggggcccgccagcgcccgggaccugauaugugcgcaguacguggccggcuacaagguccucccgccccuuauggacgugaacauggaggccgccuacaccagcucccugcucgguagcaucgcgggcgugggcuggaccgcggggcuguccagcuucgccgccauccccuucgcccaguccaucuucuaccgccugaacggcgucgggaucacccagcagguccucagcgagaaccagaagcugaucgcgaacaaguucaaccaggcucugggcgccaugcagacgggguucaccaccaccaacgaggccuuccggaaggugcaggacgccgugaacaacaacgcgcaggcccucuccaagcuggccagcgagcuguccaacacguucggcgccaucagcgcauccaucggcgacaucauccagcgccucgacgugcuggagcaggaugcgcagaucgaccggcugaucaacgggcgccucaccacccugaacgccuucguggcccagcagcugguccggagcgaguccgccgcgcucagcgcccagcuggccaaggacaaggugaacgaaugcgugaaggcccaauccaagcgcagcggcuucugcgggcagggcacccacauagucuccuucgugguuaaugcccccaacggccuguacuucaugcacgugggguacuaccccagcaaccacaucgagguggucuccgcguacggccucugcgacgccgccaaccccacgaacugcaucgccccggugaacggguacuucauaaagaccaacaacacccggaucguggacgaguggagcuacaccggcagcuccuucuacagccccgagcccaucacgucccugaacaccaaguacgucgcgccccaggugaccuaccagaacaucagcaccaaccugccgccgccccuccuggggaacuccaccggcauugauuuccaggacgagcuggacgaguucuucaagaacgugagcacguccauccccaacuuuggcagccucacccagaucaacaccacccugcuggaccucacguacgagaugcugucccugcagcaggucgugaaggcccucaacgagagcuauaucgaccugaaggagcuggggaacuacaccuacuacaacaaguggcccugguauaucuggcucggcuucaucgccggccugguggcccuggcccucugcgucuucuucauccugugcugcaccggcugcgggaccaacugcaugggcaagcugaagugcaaccguugcugcgacagguacgaagaguacgaccucgagccccacaaggugcacgugcacuga

SEQ ID NO: 1239 - RNA, 4062 nt, Artificial Sequence
  derived and/or modified CDS sequence (opt11) from MERS-CoV__AIY60558__S
augauccacagcguguuccuccucauguuccugcugacccccaccgaguccuacgucgacgucggaccggacagcuucaaauccgccugcauagagguggacauccagcagacuuucuucgacaagaccuggccccgucccaucgacgucagcaaggccgacgggauaaucuacccccaggguagaaccuacuccaacaucaccaucacguaucagggacucuucccguaccagggcgaccacggggacauguacguguacucugcgggccacgccaccggcaccacgccccagaaacuuuucguggccaacuacucccaggacgugaagcaguucgccaacggauucguggugcgcaucggcgcggcggcuaacagcaccgggaccgucaucaucuccccgagcaccuccgccaccauccggaagauauaccccgcguucaugcuuggaagcuccguggggaauuucagcgacggcaagaugggacgcuuuuucaaccacacgcucgugcugcugccggacgggugcggcacacuccugcgggcguucuacugcauccuggagccccgcuccgggaaccacugccccgccggaaacagcuacaccuccuucgccacuuaccacacgcccgcuaccgacugcagcgacggcaacuacaacagaaacgccucccucaacaguuuuaaggaguacuucaaccugcgcaacugcaccuucauguacaccuacaacaucacggaggacgaaauacuggagugguucggcaucacccagaccgcccagggugugcaccucuucuccucccgguacguggaccuguacgggggcaacauguuccaguucgcgacucugccggucuacgacacuauuaaguacuauagcaucaucccgcacuccauccgcagcauccaaagcgacagaaaggccugggccgccuuuuacgucuacaaacuucagccccugacguucuuacuagacuucagcgucgacggguacaucagacgggcgaucgacugcgguuucaacgaccuuucccaacugcacugcuccuaugaguccuucgauguggagaguggcgucuacuccgugagcuccuucgaggcuaagcccagcggguccgugguugagcaggccgagggcguggagugugacuucagcccgcuccuguccggaaccccgccccagguguacaacuucaagcgccuggucuucaccaacugcaacuacaaccucacgaagcugcucagccucuucuccgugaacgacuucacguguagccagaucagccccgccgccaucgcguccaacuguuacagcuccuuaauacuggacuacuucucauacccccucuccaugaaguccgaccugagcgucagcuccgccgggcccaucagccaguucaauuacaagcaguccuucagcaacccgacuugccugauccucgccacagugccacacaaccugaccacgauaacaaagccccuuaaguacuccuacaucaauaagugcagcaggcuacugagcgacgaccgcaccgaaguaccccagcugguuaacgccaaucaguacagccccugugugucaaucgugcccagcacggucugggaggacggggauuacuaccggaagcagcucagcccgcuggagggaggcgggugguuaguggccucaggcuccaccguugcgaugaccgagcagcuacagaugggguucggcaucaccguccaguauggaaccgacacgaacuccgucugucccaagcuggaguucgcaaaugacaccaagaucgccucacaguugggcaacugcguggaguacucccucuacggggucagcgggcgcggcguguuccagaacugcacggccguggggguccggcagcaacgcuucguguacgacgcguaccagaaccuggugggcuacuacuccgacgacggcaauuacuacugccugcgggccugcgucuccguccccguaucugucaucuaugacaaggagacaaagacgcacgccacccuguucgggagcgucgccugcgagcacaucuccagcaccaugucccaguacagccgcuccacacgcagcaugcucaagcggcgcgacaguacguacggcccucuacagacgccuguggggugcguccugggccucgugaacagcucccuguucguggaggacugcaagcugccccucgggcagagccugugcgcccugcccgacaccccgagcacgcucacgccccgguccguccguagcgucccuggcgaaaugcggcuggcuuccaucgccuucaaccaccccauacagguggaccaacugaacagcuccuacuucaaacucagcaucccgaccaauuucuccuucggagucacccaagaguacauccagacuacgauccagaaggugaccguggacugcaagcaguacguuugcaauggguuccagaagugcgaacagcuacugcgcgaguacggccaguucugcuccaagaucaaccaggcccuccacggggccaacuugcgacaagacgacuccguacgcaaccuguucgccucgguaaagucaagccaguccagccccaucauccccggguuuggaggcgacuucaaccucacccugcuggagcccgugaguaucaguaccggcucccggagcgcacgcuccgccauagaggacuugcuguuugacaaggugacgaucgcagacccgggguacaugcagggcuacgacgacugcaugcagcagggcccagccuccgcccgggaccugaucugcgcgcaauauguggccggcuacaagguucucccgccccugauggacgugaacauggaggccgccuacaccagcucccugcucggaaguaucgcgggcgugggcuggacugcuggguuguccagcuucgccgccauccccuucgcccaguccaucuucuaccggcugaacggcgucggcaucacccagcagguccucagcgagaaccagaaguuaaucgcgaacaaguucaaccaggcccugggugcuaugcagacggguuucacuaccacuaacgaggccuuccgaaaggugcaggacgccgugaacaacaacgcgcaggcgcugagcaaauuggccagcgaacuguccaacacguuuggggcaaucagcgccuccauaggcgacaucauccagcgccucgacgugcuggagcaggacgcgcagaucgaccggcugaucaacgggcgccucaccacccugaacgccuuugucgcccagcagcuggucagaagcgaguccgccgcgcucucagcccagcuggccaaagacaaggugaacgagugcgugaaagcccaguccaagcgcagcggcuuuugcggccaaggcacccacaucgucuccuucguggucaacgcgcccaacggccuguacuucaugcacgugggguacuaccccucgaaccacauugagguggucuccgcauauggacucugcgaugccgccaaccccacgaacugcaucgcucccgugaauggguacuucaucaagacgaacaacacccggaucguggacgaguggagcuacaccggcagcuccuuuuacagccccgagcccaucacgucccugaacaccaaguaugucgcgccccaggugaccuaccagaacaucagcaccaaccugccaccgccccuccuggggaacuccaccggcaucgacuuccaggacgaguuggacgaguucuucaagaauguuucgacaucuauccccaacuucggcagccuaacccagaucaacaccacccugcuggaccuaaccuacgagaugcugucccugcagcaggucgugaaggcccucaacgagagcuacaucgaccugaaggagcuggggaacuacaccuacuacaacaaguggcccugguacaucuggcucggcuucaucgccggacugguggcccuggcccucugcgucuucuucauccugugcugcaccgguugcggcacaaacugcaugggcaagcugaagugcaaccgcugcugcgaccgguacgaggaguaugaccucgaaccgcacaaggugcacguucacuga

SEQ ID NO: 1240 - RNA, 4062 nt, Artificial Sequence
  derived and/or modified CDS sequence (opt11) from MERS-CoV__AIZ74450__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucaccuaccagggccucuucccguaccaaggcgaucacggggacauguacguguacagcgcgggccacgccaccggcaccacgccccagaagcuguucgucgccaacuacucgcaggacgugaagcaguucgccaacggguucgugguccgcaucggcgccgcggccaacagcaccgggacugugaucaucucccccucgaccuccgccaccauccggaagaucuaccccgccuucaugcugggaagcuccguggggaacuucucagacggcaagaugggccgcuucuucaaccacacgcucguccuguugccggacgggugcggcacccuccugcgggcguucuacugcauccuggagccccguuccgggaaccacugcccggccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagacugcgcagggcgugcaccucuucagcucaagguacguggaccuguacgggggcaacauguuccaguucgccacccugccggucuacgacacgaucaaguacuacagcaucaucccccacuccauccgcagcauccaguccgaccggaaggccugggccgccuucuacguguauaagcuccagccccugaccuuccugcucgacuucagcguggacggguacauccgccgggcgaucgacugcggcuucaacgaccugucccagcuacacugcaguuacgaguccuucgacgucgagagcggcguguacuccgugagcuccuucgaggccaaacccagcggguccgucguggagcaggccgagggcguggagugcgacuucagcccgcuccuguccgggaccccgccccaggucuacaacuucaagcgccugguguucaccaacugcaacuacaaucucacgaagcugcugagccucuucuccgucaacgacuucacgugcagccagaucagccccgccgccaucgcguccaacugcuacagcucccugauccuggacuacuucagcuacccccucuccaugaagagugaccugagcgugagcuccgccgggcccaucucccaguucaacuacaagcaguccuucagcaacccgaccugccugauccucgccaccgugccccacaaccugaccaccaucaccaagccccugaaguacuccuacaucaacaagugcucgcggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcacagucgcgaugaccgagcagcuccagaugggguucggcaucaccgugcaguacgggaccgacacgaacuccguaugucccaagcuggaguucgccaacgacaccaagaucgccagccagcugggcaacugcgucgaauacucccucuacggcgugagcgggcgcggcguguuccagaacugcaccgccguagggguccggcagcagcgcuucguguacgacgcguaccagaaccuggucggcuacuauuccgacgacggcaacuacuacugccuucgggccugugugagcguccccgucuccgugaucuacgacaaggagaccaaaacgcacgccacccuauucgggagcguggccugcgagcacaucuccagcaccaugucccaguacagccgcuccacccgcagcauguugaagcggcgagacuccacguacggcccgcugcagacccccgucgggugcgugcugggccucgugaacagcucucuguucgucgaggacugcaagcugccucucgggcagagccugugcgccuuacccgacacgccgagcacccucacgccccgguccgugcgcagcgugcccggcgagaugcggcucgcguccaucgccuucaaccaccccauccaggucgaccagcugaacagcuccuacuucaagcucagcaucccuaccaacuucuccuucggcgugacccaggaguacauccagaccaccauccagaaggugaccgucgacugcaagcaguacgugugcaacggguuccagaaaugcgagcagcugcugcgagaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccgugagcaucagcaccggcucccggucagcgcgcuccgccaucgaggaccuccuguucgacaaagugacgaucgccgacccgggguacaugcagggcuacgaugacugcaugcaccaggggcccgccagcgcgcgggaccugaucugcgcgcaguacgucgccggcuacaaggugcucccuccccugauggacgugaacauggaggccgccuacaccagcucccugcucgggagcaucgcgggggucggcuggaccgccgggcuguccagcuucgccgccaucccuuucgcccaguccaucuuuuaccgccucaacggcguggggaucacccagcagguccucagcgagaaccagaaacuuaucgcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggaacaggacgcgcagaucgaccgacugaucaacgggcgccucaccacucugaacgccuucgucgcccagcagcuggugcggagcgaguccgcggcgcucagcgcccagcuggccaaggacaaggugaacgagugcgugaaggcccaguccaagcgcagcggcuucugcgggcagggcacccauaucguuuccuuugucgugaacgcccccaacggccuguacuucaugcacgugggguacuaccccagcaaccacaucgaggucguguccgcauacggccucugcgacgccgccaaucccacgaacugcaucgccccggucaacggguacuucaucaagaccaacaacacccggaucgucgacgaguggagcuacaccggcaguuccuucuacagccccgagcccaucacgucccugaauaccaaguacguggcgccccaggugaccuaccagaacaucagcaccaaccugccgccgccccuccuaggcaauuccaccgggaucgacuuccaggacgagcuugacgaguucuucaagaacgucagcacguccauccccaacuucggcagcuuaacccagaucaacaccacccugcuggaccucacguaugagaugcugucccugcagcaggucgugaaggcccucaacgagaguuacaucgaucugaaggagcugggcaacuacaccuacuacaacaaguggcccugguacaucuggcucggcuucaucgccgggcugguggcucuggcccucugcguguucuucauccugugcugcaccggcugcgggaccaacugcaugggcaagcugaagugcaaccgcugcugcgaccgcuacgaggaguacgaccucgagccccacaaggugcacguccacuga

SEQ ID NO: 1241 - RNA, 4062 nt, Artificial Sequence
  derived and/or modified CDS sequence (opt11) from MERS-CoV__AJD81440__S
augauccacagcguguuccugcucauguuccugcugacccccaccgaguccuacgucgacguuggcccggacagcgugaaguccgccugcaucgaggucgacauccagcagacguuuuucgacaagaccuggccucgccccaucgacgugagcaaagcugacgggaucaucuacccccagggccggaccuacuccaacaucaccaucacguaccagggccucuucccguaccagggcgaccacggggacauguacguauacagcgcgggccacgccacgggcacaacgccccaaaagcuguucgucgccaacuacucccaggacgugaagcaguucgccaacggguucgugguccgcaucggcgccgcggccaacagcaccgggaccgugaucaucaaccccuccaccuccgccacgauccggaagaucuaccccgccuucaugcugggcagcaguguggggaacuucagugacggcaagaugggccgcuucuucaaucacacgcucguucugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaauuccuucaaggaguacuucaaccugcgcaacugcaccuucauguacaccuacaacaucacggaagacgagauccuggagugguucgggaucacccagaccgcgcagggcgugcaccucuucagcagccgguacguagaccuauacggaggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucucaguggacggguacauccgccgggcgaucgacugcggcuucaacgaccugagccagcugcacugcuccuacgagagcuucgacgucgagucaggcguguacagcguguccagcuucgaggccaagcccuccgggagcgucguagagcaggccgagggcguggagugcgacuucucgccacuccugagcgggaccccgccccagguuuacaacuuuaagcgccugguguucaccaacugcaauuacaaccucacgaagcugcugucccucuucagcgucaacgacuucacgugcucccagaucagcccugccgccaucgcaagcaacugcuacuccucucugauccuggacuacuucuccuaccccuugagcaugaaguccgaccugagcguguccagcgccgggcccauaucccaguucaacuauaagcagagcuucuccaacccgaccugccugauccucgccaccgugccccacaaccugaccaccaucacgaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcaguugagcccgcuggaaggcggcggguggcugguugccagcggcuccaccgucgcgaugaccgaacagcuccagauggguuucggcaucacugugcaguacgggaccgacacgaacagcgugugcccgaaacuggaguucgccaacgacaccaaaaucgccucccagcugggcaacugcgucgaguacagccucuacggcguguccgggcgcggcguguuccagaauugcaccgccgucggggugcggcaacagcguuucguguacgacgcguaccagaaccuggucggcuacuacagcgacgacggcaacuacuacugccugcgggccugcguguccgugcccguaagcgugaucuacgacaaggagaccaagacgcacgccacccuguucggguccguggccugcgagcauaucagcuccacuaugagccaguacucccgcagcacccgcuccaugcucaagcggcgagacagcacguacggcccgcugcagaccccagucgggugcgugcugggccucgugaacuccagccuguucgucgaggacugcaagcugccccucgggcagucccuuugugcccugcccgacaccccgagcacccucacgccccgguccgugcgcuccgugcccggcgaaaugcggcuagcgagcaucgccuucaaccaccccauccaggucgaccagcugaacuccagcuacuucaagcucuccaucccgaccaacuucuccuucggcgugacccaggaguacauccagaccaccauccagaaggugaccgucgacugcaagcaauacgugugcaacggguuccagaagugcgagcagcugcuaagagaguacggccaguucugcuccaagaucaaccaggcccuccauggggccaaccugcggcaggacgacagcgugcgcaaccuguucgccuccgucaagagcucccagagcuccccaaucauacccggcuucgggggcgacuucaaccucacccugcuggagcccgugagcaucuccaccggcagccggagcgcgcgcagcgccaucgaggaccuccuguucgacaaggugacgaucgccgacccgggguacaugcagggcuacgacgacugcaugcagcaggggcccgccuccgcccgggaccugaucugcgcgcaauacgucgccggcuacaaggugcucccgccccugauggacgugaacauggaggccgccuacaccagcagccuguuaggguccaucgcgggcgucggcuggaccgccgggcugagcuccuucgccgccauccccuucgcccagagcaucuucuacaggcugaacgguguggggaucacccagcagguccucuccgagaaccagaagcugaucgcgaacaaguucaaccaggcccugggcgccaugcagacgggguucaccacgaccaacgaggccuuccggaaggugcaggacgccgugaacaacaacgcgcaggcccucagcaagcuggccuccgagcugagcaacacuuucggcgccaucuccgccagcaucggcgacaucauccagcgccucgacgugcuggagcaggacgcgcagaucgaccgucugaucaacgggcgccucaccacccugaacgccuucgucgcccagcagcuggugcgguccgagagcgccgcgcucuccgcccagcuggccaaggacaaggugaacgagugcgucaaggcccagagcaagcgcuccggcuucugcgggcagggcacccacaucgugagcuucgucgugaacgcccccaacggccuguacuucaugcacgugggguacuaccccuccaaccacaucgaggucgugagcgcguacggccucugcgaugccgcgaaccccacgaacugcaucgccccggugaacggguacuucaucaagaccaacaacacccggaucgucgacgagugguccuacaccggcagcagcuucuacgcccccgagcccaucacgucccucaacacaaaauacguggcgccccaggugaccuaccagaauaucagcaccaaccugccgccgccccuccuggguaacuccaccggcaucgacuuccaggacgagcuggacgaguucuucaagaacgucagcacguccauccccaacuucggcagccucacccagaucaauaccacccugcuggaccucacguacgagaugcuaucccugcagcagguagugaaggcccucaacgagagcuacaucgaccugaaggagcuggggaacuacaccuacuacaacaaguggcccugguacaucuggcucggcuucaucgccgggcugguggcccuggcccucugcguguucuucaucuugugcugcaccggcugcgggaccaacugcaugggcaagcugaagugcaaccgcugcugcgaccgcuacgaggaguacgaccucgaaccccacaaggugcacguccacuga

SEQ ID NO: 1242 - RNA, 4062 nt, Artificial Sequence; identical to SEQ ID NO: 330
  derived and/or modified CDS sequence (opt11) from MERS-CoV__AKI29284__S

SEQ ID NO: 1243 - RNA, 4062 nt, Artificial Sequence
  derived and/or modified CDS sequence (opt11) from MERS-CoV__AKL59401__S
augauccacucaguguucuuacucauguuccuacuaacccccaccgaguccuacguggaugugggcccggacagcguuaagucugccugcaucgaggucgacauacagcaaacguucuucgacaagaccuggccccgccccaucgacguuucaaaggcggacgggaucaucuacccccagggccggaccuacuccaacaucacgaucacguaccaaggccucuucccguaucaaggggaccacggggacauguacguguacuccgcgggccacgcuaccggcaccacuccucagaagcuguucguggcaaauuacucccaggacgugaagcaguucgccaacggguucgucguucguaucggcgccgcggcuaacagcaccgggaccgugaucaucuccccuagcacccgggccaccauccgcaagauuuaucccgcauucaugcugggcuccagcgugggaaacuucuccgacggcaagaugggccgguucuucaaccacacgcucguccugcugccggaugggugcggcacccuacugcgcgcguucuacuguauccuugagccucggagcgggaaccauugccccgcuggcaauuccuacaccagcuucgccacguaccacacgccggccaccgauugcuccgacggcaacuacaaccgcaacgccagccucaacuccuucaaggaguacuucaaccugcggaacugcaccuucauguauaccuacaacaucacggaagacgaaauccuggagugguucgggaucacccagaccgcacaaggcgugcaccuguucagcagcagguacgucgaccuguacgggggaaacauguuccaguucgccacccugccagucuacgacacgauuaaguauuacuccaucauuccacacagcauccgguccauccaguccgaccgcaaggccugggccgccuucuacgucuauaagcuccaaccccugaccuuccugcucgacuuuucuguggacggguacauccggcgugcgaucgacugcggcuucaacgaccugagucagcugcacugcuccuacgagagcuuugacgucgaguccggcguguacagcguguccagcuucgaggccaagcccuccgggagcgucguggaacaggccgagggcguggagugcgacuucuccccgcuccugagcggcaccccgccccaggucuacaacuucaagcgauugguguucaccaacugcaacuacaaccucacgaagcugcugucccucuucagcguaaacgacuucacgugcucccagaucagccccgccgccaucgcgagcaacugcuacuccagccuuauccuggacuacuuuuccuacccccucagcaugaaguccgaccugagcguguccagcgccggucccauaucccaguucaacuacaagcagagcuucuccaacccgaccugccugaucuuagccaccgugccccacaaccugaccaccaucaccaagccccuaaaauacagcuacaucaacaagugcucccgccuccugagcgacgaccggaccgaagucccccagcugguaaacgccaaccaguacucccccugcgugagcauccuccccuccacaguaugggaggacggagacuacuaccgcaagcagcugagcccgcuggagggcggcggauggcuuguggccagcggcuccaccguggcuaugaccgagcagcuucaaaugggguucggcaucaccguccaguacgggaccgacacaaacagcgugugcccgaagcuggaguucgccaacgacaccaagaucgcgucccagcucgguaacugcguggaguacagccuguacggcguauccggcaggggcguguuucagaacugcaccgcgguggggguccgucagcaacgguucguuuacgacgcuuaccagaaccuggugggcuacuacagcgaugaugggaacuacuacugccugcgcgccugcguguccguccccgugagcgucaucuacgacaaggagaccaagacgcacgccaccuuguucgggaguguggccugcgagcacauaucauccaccaugagccaguacucccgcagcacucgguccaugcugaagaggcgggacagcacauacggcccgcuacagacccccguggguugcgucuuaggccuggucaacagcagccuguucguggaggacugcaagcugccccugggucagucccugugcgcccuccccgacaccccgagcacgcugacgccccgcagcguaagguccgugcccggcgagaugagacuggcgagcaucgccuucaaccaccccauccagguggaccagcucaauuccagcuacuuuaaacuguccaucccgaccaacuuuagcuucggagucacccaggaguacauacagaccacgauccagaaggugaccguggacugcaagcaguacgucugcaacggguuccagaagugcgagcagcugcuucgggaguauggccaguuuugcagcaagaucaaccaggcccuacacggggcaaaccugcgccaggacgacagcgugcggaaucucuucgcuuccgucaagucuucccaaagcucccccaucaucccaggcuucgggggcgacuucaaccugacccugcucgagcccgugagcauuuccaccggcagccgcuccgcgcgaagcgccaucgaggacuugcuguucgacaaggugacgaucgccgacccgggauacaugcagggcuacgacgacuguaugcagcaggggcccgccagcgcccgcgacuugaucugcgcgcaguacguggccggcuacaaaguccucccgccucugauggacgugaacauggaggcagccuacacgagcagccuccuggggucuaucgcgggcgugggcuggacggccgggcugagcuccuucgccgccaucccguucgcccagagcauuuucuaucggcuaaacggcgucgguaucacccagcagguccuguccgaaaaccagaagcugaucgccaacaaguucaaccaagcccucggcgcaaugcagacgggguucaccaccacuaacgaggcguuccgcaaggugcaggacgccgucaacaacaacgcgcaggcccugucgaagcuggccuccgagcucucgaauacguucggcgccaucuccgcgagcaucggcgacaucauccagcgccuggacguacuggagcaggacgcgcaaaucgaccgccucauaaacgggcggcugaccacccuuaacgccuucguggcccagcagcucguccgauccgagagcgcugcgcuguccgcccaacuagccaaggacaaggugaacgagugcguuaaggcccagagcaagcggucgggcuucugcgggcagggcacccacauugucagcuucguggucaacgcccccaacggccucuacuucaugcacgugggguacuaccccuccaaccacaucgaggucgucagcgcguacggccuuugcgacgcugcgaaccccacgaacugcaucgccccggugaacggguacuucaucaagaccaacaacacccgcaucguggacgagugguccuacaccggcagcagcuucuacgcccccgagcccaucacgucucuuaacaccaaguacgucgcgccacaggugaccuaccaaaacauaagcaccaaccugccgccgccccugcuggggaacagcacaggcaucgauuuccaggacgaacucgaugaguuuuucaagaacgugucuaccaguauccccaacuucggcagccugacucagaucaauacgacccugcucgaccugacguaugagaugcuguccuuacagcaagucgucaaagcccugaacgaaagcuacaucgauuuaaaggagcucgggaacuacaccuacuacaacaaguggcccugguacaucuggcugggcuuuaucgccgggcugguggcccucgcccugugcgucuucuucauccugugcugcaccggcugcgggacgaacugcaugggcaagcucaagugcaaccguugcugcgaccgguacgaagaguacgaccuggaaccccacaaggugcacgugcacuga

SEQ ID NO: 1244 - RNA, 4062 nt, Artificial Sequence
  derived and/or modified CDS sequence (opt11) from MERS-CoV__AKM76229__S
augauccacagcguauuccugcucauguuucugcugacccccaccgaguccuacgucgacguaggcccggacagcgugaaguccgccugcaucgaggucgacauccagcagacguucuucgacaagaccuggccccgccccaucgacgugagcaaagccgacgggaucauauacccccagggccgaaccuacuccaacaucaccaucacguaccagggccucuucccguaccaaggcgaccauggggauauguacguguauagcgcgggccacgccaccggcaccacaccccagaaacuguucguggccaacuacucccaggacgugaagcaguucgccaacggguucgugguccguauaggggccgcggccaacucuaccgggaccgugaucaucucccccagcaccuccgccacuauccggaagaucuaccccgccuucaugcugggaagcuccguggggaacuucagcgacggcaagaugggacgcuucuucaaccacacgcucguccugcugccggaugggugcggcacccuccugcgggcguucuacugcauccuggagccccgcuccgggaaccacugccccgcuggcaacagcuacaccuccuucgccaccuaccacacgcccgccaccgacugcagcgacggcaauuacaaucggaacgccucccucaacagcuucaaggaguacuucaaccugcgcaacuguaccuucauguauaccuacaacaucacggaggacgagauucuggagugguuugggaucacccagaccgcgcagggcguucaucucuuuagcuccagguauguggaccuguacgggggcaacauguuccaguucgccacccugccggucuacgacacgaucaaguacuacagcaucaucccccacuccauccgcagcauccaguccgaccggaaggccugggcagccuucuacguuuacaagcuccagccccugaccuuccuacucgacuucagcguugacggguacauccgccgggcgaucgacugcggcuucaacgaccugucccagcugcacugcagcuacgagagcuucgaugucgagagcggcguuuacuccgugagcuccuucgaggcaaagcccagcggauccgucguggagcaggccgagggcguggagugcgacuucagcccccuacuguccgggacuccgccccaggucuacaacuucaagcgccugguguuuaccaacugcaacuacaaccucacgaaguugcugagccucuucuccgucaacgacuucacgugcagccagaucagccccgcggccaucgcguccaacuguuacagcucccugaucuuagacuacuucagcuacccccucucgaugaagucagaccugagcgugagcuccgccgggccuaucagccaguucaacuacaagcaguccuucagcaauccaaccugccugauccucgccaccgugccccacaaccugaccaccaucaccaagccucugaaguacuccuauauuaacaagugcagccggcuccuguccgacgaucgcaccgaggucccccagcugguuaacgccaaccaguacagccccugcguguccaucguccccagcacugugugggaagacggggacuacuaccggaagcagcucagcccgcuggagggcggcggguggcugguggccuccgggagcaccgucgcgaugaccgagcagcuucagauggguuucggcaucaccguccaguacgggacugacacgaacuccgugugccccaagcuggaguucgcaaacgacaccaagaucgccucgcaacugggcaacugcgucgaguacucccuuuauggcgugagcgggcgcggcguguuccagaacugcaccgccgucggggugaggcagcagcgcuucguguacgacgcguaccagaaccuggucggcuacuacuccgacgacggcaacuacuacugccugagagccugcgugagcguucccgucuccgugaucuacgacaaggagaccaagacgcacgccacccuuuucgggagcguggccugcgaacacaucucuagcaccaugucccaguacucucgcucaacccgcaguaugcuaaagcggcgugacuccacguacggcccgcugcagacucccgucgggugcgugcugggccucgugaacuccucccuguucgucgaggacugcaagcugccguuggggcagagccugugcgccuuacccgacaccccgagcccccucacgccucgguccgugcgcagcgugcccggcgagaugcggcuggcguccauugcuuucaaccacccgauccaggucgaccagcugaacagcuccuacuucaagcucagcauccccaccaauuuuuccuucggcgugacccaggaguacauucaaaccaccauccagaaggugacggucgacuguaaacaguacaucugcaacggauuccagaagugcgagcagcuacuacgcgaguacggccaguucugcagcaagaucaaccaggcccuccacggggccaaccugcggcaggacgacuccgugagaaaccuguucgccagcgugaaguccagccaguccagcccuaucaucccaggcuucgggggcgacuucaaccucacgcugcuggagccggucucaaucagcaccggcucccggagcgcgcgcuccgcaaucgaggaccuccuguucgacaaggucaccaucgccgaucccggguacaugcagggcuacgacgacugcaugcagcaggggcccgccagcgcccgggaucugaucugcgcgcaguacguggccggcuacaaaguccugccgccgcucauggacgugaacauggaggccgcguacacgagcucccucuuagggagcauugcgggcgugggcuggaccgccgggcuguccagcuucgccgccauccccuucgcccaguccaucuuuuaccgccugaacggcgucggaaucacccagcaaguccucagcgagaaccagaagcugaucgcgaacaaguucaaccaggcacugggcgccaugcagaccggguucacgaccacgaaugaggccuuccggaaggugcaagacgcagucaacaacaacgcgcaggcucucucaaagcuggccagcgaacuguccaacaccuucggcgccaucagcgccuccaucggcgacaucauccagcgccucgauguucuggagcaggacgcgcagaucgaccggcugaucaacgggcgccucacgacccugaacgccuucgucgcccagcagcugguccggagcgaguccgccgcgcucagcgcccagcuggccaaggacaaggugaacgagugcgugaaagcccaguccaagcgcagcggcuucugcgggcagggcacccauauugucuccuucguggucaacgcuccaaacggccuguacuucaugcacgugggcuacuaccccagcaaccacaucgagguggucuccgcguacggccucugcgacgccgccaacccgaccaacugcaucgcccccgugaacggguacuucaucaagaccaacaacacccggauuguggacgaguggagcuauaccggcagcuccuucuacagccccgagcccaucaccucccugaacacgaaguacgucgcgccccaggugaccuaccaaaacaucagcaccaaucugcccccgccccuccugggcaacuccaccggcaucgacuuccaagacgagcuggacgaguucuucaagaacgugucuaccuccauccccaacuucggcagccucacgcagaucaacaccacccugcuggaccucaccuacgagaugcuguccuugcagcaggucguuaaggcccucaacgagagcuacaucgaccugaaggagcuggggaacuacacguauuacaacaaguggcccugguauaucuggcucggcuucaucgccgggcugguggcccuggcccuuugcgucuucuucauccugugcugcaccggcugcgggaccaacugcaugggcaagcugaagugcaaccgcugcugugaccgcuacgaggaguacgaccucgagccgcacaaggugcaugugcacuga

SEQ ID NO: 1245 - RNA, 4062 nt, Artificial Sequence
  derived and/or modified CDS sequence (opt11) from MERS-CoV__AKM76239__S
augauccacagcguauuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgauggcaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccuucgggcguucuacugcauccuggagccccgcuccgggaaccacugccccgccggcaacagcuacaccuccuucgccaccuaccacacgcccgccaccgacugcagcgacggcaacuacaaccggaacgccucccucaacuccuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguauuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugucauccuucgaggccaagcccagcggguccgucguggagcaggccgaagguguggagugcgacuucagcccgcuccuguccgggaccccgccucaggucuacaacuucaagcgccugguguucaccaacugcaacuacaaccucacuaagcugcugagccucuucuccgucaacgacuucacgugcagccagaucagccccgccgccaucgcguccaauugcuacagcucccuuauccuggacuauuucagcuacccccucuccaugaaguccgaccugagcgugagcuccgccggacccaucagccaguucaacuacaagcaauccuucagcaacccgaccugccugauccucgccaccgugccccacaaccugaccaccaucaccaagccccugaaguacagcuacaucaacaagugcagccggcuccuguccgacgaccgcaccgagcugccccagcucguuaacgccaaccaguacagccccugcguguccaucgugcccagcacggucugggaggacggggacuacuaccggaagcagcugagcccguuggagggcggcggguggcucguggccuccggcagcaccguggcgaugaccgagcagcugcagaugggguucggcaucaccgugcaguacgggaccgacacgaacuccgugugccccaagcuggaguucgcaaacgacaccaagaucgccagccagcucggcaacugcguggaguacagccuguacggcgucagcgggcgcggcguguuccagaacugcaccgccguugggguccggcagcagcgguuuguguacgacgcguaccagaaccuggugggcuacuacuccgacgacggcaacuacuacugucugcgagccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggguugcgugcucggccuggugaacagcucccuguucguagaggacugcaagcucccccuggggcagagccugugcgcccuccccgacaccccgagcacccugacgccccgguccguccgcagcgugcccggggagaugcgcuuggcguccaucgccuucaaccaccccauccagguggaccagcucaacagcuccuacuucaagcugagcaucccgaccaacuucuccuucggcgugacccaggaguacauccagaccacgauccagaaggugaccguggacugcaagcaguacaucugcaacggguuccagaagugcgagcagcugcuccgcgaauacggccaauucuguagcaagaucaaccaggcccugcacggggccaaccugcggcaggacgauuccguccgcaaccucuucgccagcgugaaguccagccaguccagccccaucauccccggcuucgggggcgacuucaaccugacccuguuagagcccguguccaucaguaccggcucccggagcgcgcgcuccgccaucgaggaccuacuguucgacaaggucacgaucgccgacccaggguauaugcagggcuacgacgacugcaugcagcaagggcccgccagcgcccgggaccucaucugugcgcaguacguggccggcuacaaggugcugccgccccugauggacgucaacauggaggcggccuacaccagcagccuccuggggagcaucgcuggcgugggcuggaccgccggucuguccagcuucgcugccauccccuucgcccaguccaucuuuuaccgccucaacggcguagggaucacccagcagguccugagcgagaaccagaagcuaaucgcuaauaaguucaaccaggcccucggcgccaugcagacgggguucaccacuaccaaugaagccuuccggaaggugcaggacgccgugaacaacaacgcgcaggcccuguccaagcuggccagcgagcucuccaacacguucggcgccaucagcgccuccaucggggacaucauccagcgccuggauguccucgagcaggacgcgcagaucgaccggcucaucaacgggcgccugacaacccugaacgccuucguggcccagcagcucgugcggagcgaguccgccgcgcugucggcccaacuggccaaggacaaggucaacgaaugcgugaaggcccaguccaagcgcagcggcuucugcgggcagggcacccacaucguuuccuucguagugaacgcccccaacggccucuacuucaugcacgucggguacuaccccagcaaucacaucgaggucguguccgcguauggccuuugcgacgucgccaaccccacgaacugcaucgcaccggugaacggguacuucaucaagaccaacaacacccggauuguggacgaguggagcuacaccggcagcuccuucuacagccccgaacccaucacgucccugaacaccaaguacgucgcgccccaggugaccuaccagaacaucagcaccaaccucccgccgcccuuacuggggaacagcaccggcaucgacuuccaggacgagcucgacgaguucuucaaaaacuucagcacguccauccccaacuucggcagccugacccagaucaacaccacccugcucgaccugacguaugagaugcugucccuccagcaggucgugaaggcccugaacgagagcuacauagaccugaaggagcucgggaacuacaccuacuacaacaaguggcccugguacaucuggcugggcuucaucgccgggcugguggcccucgcccugugcguguucuucauccugugcugcaccggcugcgggaccaacugcaugggcaagcucaagugcaaccgcugcugcgaccgcuacgaggaguacgaucuggagccucacaagguccacgugcacuga

SEQ ID NO: 1246 - RNA, 4062 nt, Artificial Sequence; identical to SEQ ID NO: 334
  derived and/or modified CDS sequence (opt11) from MERS-CoV__AKN11072__S

SEQ ID NO: 1247 - RNA, 4062 nt, Artificial Sequence
  derived and/or modified CDS sequence (opt11) from MERS-CoV__AKN11074__S
augauacacagcguguuccugcuuauguuccugcugacccccacggaguccuacgucgacgucggcccggacagcgugaagucggccugcaucgaggucgacauccagcagacguucuucgacaaaaccuggccaagacccaucgacgugagcaaggccgacgguaucaucuacccccagggccggaccuacuccaacaucaccaucaccuaccagggcuuguuuccguaccagggcgaccauggggacauguacguauacagcgccggccacgcgaccggcaccacgccccagaagcuguucguugcuaacuauucccaagaugucaagcaguuugccaaugguuucguggugcgcaucggcgccgcugcuaacagcaccgggaccgugaucauuucccccucaacauccgcuaccauccggaagaucuaccccgcauucaugcugggcagcuccguggggaacuucagcgacggcaagaugggacgcuucuucaaccacacgcuaguccugcugccggacgggugcggaacacuccugcgagcauucuacugcauccuagagccccgcucagggaaccacugccccgccggcaacucauacaccagcuuugcgaccuaccauacuccugccaccgacugcagcgacggaaacuacaaccgcaacgccucgcucaacagcuucaaggaauacuucaaccugcgaaacugcaccuucauguacaccuacaacaucacugaggacgaaauucuggagugguuugggaucacccagacugcgcagggcguacaccucuucucaagucgguacgucgaucuguacgggggcaacauguuucaguucgccacccugccggucuacgacacgaucaaguacuacucgaucaucccgcacuccauacgcagcauacaauccgaccggaaggccugggcugccuucuacguguacaagcuccaaccccuaacauucuugcucgacuucucuguggacggauacauccgccgggcgaucgauuguggcuuuaacgacuugucccaauuacacuguuccuacgaauccuucgaugucgaaagcggcgucuacuccguguccuccuucgaagcgaaacccagcggguccgucguggagcaggccgaaggcguggaaugcgacuucagcccgcuccuguccggcaccccuccccaggucuauaacuucaagcgccugguguucaccaauugcaauuacaaccucacuaaacugcugagccucuucagugugaacgacuucacgugcagccaaaucagccccgccgccauagcaucgaacugcuacagcucacugauccuggacuacuucagcuacccccucuccaugaaguccgaccucuccgugucaagcgccggccccaucagucaguucaacuauaagcaguccuucucaaacccuaccugucugauuuuagccaccgugccacauaaucugaccaccaucaccaagccccugaaguauagcuacaucaacaaaugcagccggcuccugucugacgaccgcaccgagguuccccagcuugucaaugccaaccaguauagcccuugcguuaguacaguucccagcaccgugugggaagacggggacuacuacagaaagcagcucagcccguuagaaggcgguggguggcugguggccuccggcuccaccgucgcuaugacagagcagcuccagaugggguuuggcaucaccgugcaguauggaacagacaccaacucagugugcccuaagcuggaguucgccaacgacaccaagaucgccagccaacucggcaauugcguagaauacucccucuauggcgugagcggucgcggcguguuccaaaacugcaccgcggucggggugcggcagcagcacuuuguguacgacgcguaccagaaccuugugggauacuacucggaugaugggaacuacuacugccucagggccugcgugagcgugcccguuuccgugaucuacgauaaagagacaaagacccacgccacgcuguucggaagcguggccugugagcacaucuccagcaccaugucccaguacucucguucgacacgcagcaugcuuaagcggagagacuccacuuacggcccgcuacaaaccccagucgggugcgugcuuggccucgugaacagcucccuguucgucgaagacugcaagcugccccucgggcagucgcugugcgcccugccagacacccccagcacgcugacgccccgcucagucaggucaguucccggcgagaugcgcuuagcuuccauagccuucaaccaccccauacaggucgaccaacugaacagcuccuacuuuaagcucagcaucccgaccaacuuuuccuuuggggugacccaggaauacauccaaacuaccauucaaaagguuacaguagacugcaagcaguacgugugcaacgguuuccagaagugcgagcaacugcuccgggaauauggccaguucugcagcaagaucaaccaggcccuccacggggccaaccugcgccaggaugacuccgugcguaaccuguucgccagcgucaagagcagccagagcuccccuaucauccccgguuuuggaggggacuuuaaccucacccuucucgagcccguguccaucagcacggggucccgcagcgcgcgguccgccaucgaagacuuacuguucgacaaagugaccaucgccgacccaggguauaugcagggcuacgaugauugcaugcagcaggggcccgccagcgcccgcgaccucaucugcgcgcaguacguggccggcuauaaagugcuuccgccccugauggacgugaacauggaggccgccuauacgucuucccuccuaggcagcaucgcgggcgucggcuggaccgcggggcuguccucguucgccgccauccccuucgcccaauccaucuucuacagacugaacgguguagggaucacgcaacagguccucagcgagaaccagaagcucauagcgaauaaauucaaccaagcccugggcgcuaugcagacuggauucacuaccaccaacgaggcuuucagaaaggugcaggaugccgugaacaacaacgcgcaggcucucucuaaacuggccagcgaacuguccaacaccuuuggcgccaucagcgccucaaucggggacauuauccagcggcucgacgugcuggaacaggacgcgcagauugaccgucuaaucaacggccggcucacgacccuuaaugccuucgucgcccagcagcuggugcggagugagagcgccgcacucagcgcucagcucgccaaggacaaggugaaugagugcgucaaggcgcaguccaagcggagcggcuucugcgggcaggguacacacaucguguccuucgucgugaacgcucccaacggacuguacuuuaugcacguaggguacuaccccucgaaccacauagaggucguguccgcguauggccugugcgacgcagccaaccccaccaacugcaucgccccggugaauggguacuucaucaagaccaauaacacccgcaucgucgacgaguggagcuacacgggcagcucuuucuacgcgcccgagcccaucaccagccucaacaccaaguacguggcgccccaggugaccuaccaaaacaucuccaccaacuuaccgccgccucuccuggggaacagcaccggcauugacuuccaggacgagcuggacgaguucuuuaaaaacgucuccacgagcauccccaacuuuggaucacucacccagaucaacaccacccugcuggacuugacuuaugagaugcugagccugcaacaggucgugaaggcccugaacgaauccuacaucgaccugaaagagcuggggaacuacaccuacuacaacaaguggcccugguacaucuggcucggcuucaucgccggacugguggcccuugcccuguguguguucuucauccuguguugcaccgguugcgguacgaacugcaugggcaaauuaaagugcaacagaugcugcgaccgcuacgaggaguacgaccucgagccgcacaaggugcacguccacuga

SEQ ID NO: 1248 - RNA, 4062 nt, Artificial Sequence
  derived and/or modified CDS sequence (opt11) from MERS-CoV__AKN24803__S
auggugcacagcgucuuccucuuaauguuccuccugacacccaccgaguccuacguagacgugggccccgacagcgucaaguccgcgugcaucgagguggacauccagcagacguucuucgacaagaccuggccccgccccauagacgugagcaaggccgacgggaucaucuacccccaggggcggaccuacuccaacaucaccaucacguaccagggccucuucccguaccagggcgaucacggggacauguacgucuacagcgcgggccacgccacaggcaccacgccccagaagcuguucguggccaacuacucgcaggacgugaagcaauucgccaacggguucgucgugcgcaucggcgcggcggccaauagcaccgggaccgugaucaucucccccuccaccuccgccaccauccggaagaucuaccccgccuucaugcugggcagcuccgucgggaacuucagcgauggcaagaugggcagauucuucaaccacacgcucgugcugcugccggacgggugcggcacgcuccugcgggcguucuauugcaucuuggagccucgcuccgggaaccacugccccgccggcaacagcuacaccaguuucgcaaccuaccauacgcccgccacggacugcagcgacggcaacuacaaccggaacgccucccucaacagcuucaaggaguauuucaaccugcgcaacugcaccuucauguauaccuacaacaucacggaggacgagauccuggagugguucgggauuacccagaccgcgcagggcgugcaccucuucagcucccgguacgucgaccuguaugggggcaacauguuccaguucgccacccuaccgguguacgacacgaucaaguacuacagcaucaucccucacuccauccgcagcauccaguccgaccggaaagccugggccgccuucuacguguacaagcuccaaccccuuaccuuccugcucgacuucagcguagacggguacauccgccgggcgaucgacugcggcuucaacgaccuuucccagcugcacugcuccuacgaguccuucgacguggagagcggcguguacuccgucagcuccuucgaggccaagccuagcggguccguaguggaacaggcagagggcguugagugugacuucucaccgcuccuguccgggaccccgccccagguguacaacuucaagcgcuuagucuucaccaacugcaacuacaacuuuacgaagcuccugucacuguucuccgugaacgacuucacgugcagccagaucagccccgccgcaaucgcgucuaacugcuauagcucacucauccuggacuacuucagcuacccccuguccaugaaguccgaucucagcgugagcuccgccgggcccaucagccaauucaacuacaagcaguccuucagcaacccgacaugccugauccuggccaccgucccccacaaccucaccaccauuaccaagccucugaaguacuccuacaucaacaagugcagccggcugcucuccgacgaccgaacagaggugccccagcuggugaacgcuaaccaguacagcccgugcguguccaucgugcccuccacggugugggaagacggggacuacuaccggaagcagcugagcccgcucgagggcggaggguggcuggucgccuccggcagcaccguggcgaugaccgagcagcugcagaugggguucggcaucaccgugcaguacgggaccgacacgaacuccgucagcccaaagcucgaguucgcuaacgacaccaagaucgccucccagcugggcaacuguguggaguacagccuguacggcguguccgggcgcggcgucuuucaaaauugcaccgccguaggggugcggcagcagcgcuucgucuaugacgcguaccagaaccucgugggcuacuacagcgacgacggcaacuacuacugcuugcgggccugcguguccguccccgugagcgugauauacgacaaggagaccaagacgcacgccacccuguucggguccgucgcuugcgagcacaucagcuccaccaugagccaguauucucgcagcacccgcuccaugcugaagcggcgcgauucaacguacggcccgcuccagacccccgugggaugugugcugggccuggucaacuccagccucuucguggaggacugcaagcucccccugggucagagccugugcgcccugcccgacaccccguccacccugacgccccggagcguucgcuccguccccggcgagaugcggcucgcgagcaucgccuucaaccacccgauacagguggaccagcugaacucuagcuacuucaagcuguccaucccgaccaacuuuagcuucggagugacccaggaguacauccagaccacgauccagaaggucaccgucgacuguaagcaguacgucugcaacggguuccagaagugcgagcagcucuugcgcgaauacggccaguucuguuccaagaucaaccaggcccugcacggggccaaccuccgccaggacgacagcguccgcaaccuguucgccuccgucaagagcucccagagcucccccaucauccccggcuucggaggcgacuucaaccugacccuccuggagcccgucagcaucaguaccggcagccgguccgcgcgcucugccauagaggaccuccuguucgacaaggugaccauagccgacccaggcuacaugcagggcuacgacgacugcaugcagcaggggcccgccagcgcccgggaccugaucugcgcgcaauaugucgccggcuacaaggugcuuccgccccucauggacgucaacauggaggccgccuacaccuccagccugcugggguccaucgcgggcgugggcuggacggccgggcucagcuccuucgccgccauccccuucgcccagagcaucuucuaucgccugaacggcguggggaucacacagcagguccuguccgagaaccagaagcucaucgcgaacaaguucaaccaggcccugggcgccaugcagacgggguucaccaccaccaacgaagccuuccggaaggugcaggacgccgugaacaacaacgcucaagcccugagcaagcucgccuccgagcugagcaacacguucggagccaucucggcgagcaucggcgacaucauucagcgccuggacgugcucgagcaggacgcgcagaucgaccggcugauaaacgggcgccugaccacccucaacgcauucguggcccagcagcuagugcgguccgagagcgccgcgcuguccgcccagcucgcgaaagauaagguuaacgagugcgugaaggcacagagcaagcguuccggcuucugcggacagggaacccacauugucagcuucguggugaacgcccccaacggccuguacuucaugcacgucggguacuacccaucaaaccacauagagguggugagcgcguacggccugugcgacgccgccaaccccaccaacugcaucgccccggugaacggguacuucaucaagacgaacaacacgcggaucgucgacgaguggucauacaccggcuccucuuucuacgcccccgagccuaucacgucccucaacaccaaguacguggcgccccaggucaccuaucagaacaucagcaccaaccugccgccgccccugcucgggaauagcaccggcaucgacuuccaggacgagcuugacgaguucuucaagaacgugagcacguccauccccaauuuuggcagccugacccagaucaacaccacccuccuggaccuaacguacgaaaugcucucccugcagcagguuguaaaggcccugaacgagagcuauaucgaccucaaggaacuggggaacuacaccuacuacaacaaguggcccugguacaucuggcugggcuucaucgcggggcucguggcccuggcccugugcguauucuucauccucugcugcaccggcugcgggacaaauugcaugggcaaacugaaguguaaccgcugcugcgaccgcuacgaagaguacgaccuggagccgcauaagguccaugugcacuga

SEQ ID NO: 1249 - RNA, 4062 nt, Artificial Sequence
  derived and/or modified CDS sequence (opt11) from MERS-CoV__AKN24812__S
augauccacagcguguuccugcucauguuccugcugacgcccaccgaguccuacgucgacgugggcccggacucugugaaguccgccugcaucgagguugacauccagcagacguucuucgacaagacguggccccgccccaucgacgugagcaaggccgacgggaucauauacccccagggccgaaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaauuugcgaacggguucguuguccguaucggcgccgcggccaacagcaccgggaccguaauuaucucccccagcaccuccgcaaccauucggaagaucuaccccgcuuucauguuaggcagcuccguggggaacuuuagcgacggcaagaugggccgcuucuucaaccacacucucguccugcugccggacgggugcggaacccuccugcgggcguucuauugcauacuggagccccguuccgggaaccacugccccgccggcaacagcuacacuuccuucgcaaccuaccacacgccggccaccgacugcagcgacggcaacuacaaccggaacgccucccucaacagcuucaaagaguacuuuaaccugcgcaacugcaccuucauguacaccuacaacaucacggaggacgagauccuggagugguucgggaucacccaaaccgcgcagggcgugcaccucuucagcucccgguacguggaccuguacgggggcaacauguuccaauucgccacccugccggucuacgacacuaucaaguacuacagcaucaucccccauuccauccgcagcauccaguccgaccggaaggccugggccgccuucugcguguacaagcuccagccccugaccuuccugcucgacuucucuguggacggguauauccgccgggcgaucgacugcggcuucaaugaccugucccagcugcacugcaguuacgaguccuucgacgucgagagcggcguguauuccgugagcuccuucgaggccaagcccagcgggagcgucguggagcaggccgagggcguggagugcgacuucuccccgcuccuguccgggaccccgccccagguguacaacuucaagcgccugguguucaccaacugcaauuacaacuuuacuaagcuccugagccuguucucagucaacgacuucacgugcagccagaucagccccgccgcaauugcguccaacugcuacagcucccucauccuugacuacuucagcuauccccuguccaugaaaagcgaccugagcguuagcuccgccgggcccaucagccaguucaacuacaagcaguccuuuagcaauccgaccugccuuauccuggccacugugccccacaaccucaccaccaucaccaagccacugaaguacuccuacaucaacaagugcagccggcugcucuccgacgaccgcaccgaggucccccagcuagugaacgccaaccaguacagccccugcguguccaucguucccagcacggugugggaggacggggacuacuaccggaagcagcugaguccgcucgagggcggcgguuggcugguggccucgggcagcaccgucgcgaugaccgagcagcugcaaaugggguucggcaucaccgugcaguacgggaccgacacgaacagcgugugcccgaagcucgaguucgccaacgacacuaagaucgccagucagcugggcaacugcgucgaguacucccuguacggcgugagcgggcgcggcguguuccaaaacugcaccgccgucggggugcgucagcagcgcuucguguacgacgcguaccaaaaccucgucggcuauuacuccgacgacggcaauuacuacugcuugcgggccugcgugagcgugcccgucuccguaauuuaugacaaggagaccaagacgcacgccacacuguucgggagcguggccugugagcacaucuccagcaccaugucccaguacucgcgcuccacccgcagcaugcugaagcggcgugacuccacguacgggccgcuccagacccccgucgggugcgugcugggccuggugaacagcucccucuucgucgaagacugcaagcugccccuggggcagagccucugcgcccugcccgacacuccgagcacccugacgccgugcuccgugcggagcguccccggcgagaugcgccucgcgucgaucgccuucaaccaccccauccaggucgaccaacugaauagcuccuacuucaagcugagcaucccgaccaacuucuccuucggcgugacccaggaguacauccagaccacgauccagaaggugaccgucgacugcaagcaguacguuugcaacggguuccagaagugcgagcaacuccugcgggaguacggccaguucuguagcaagaucaaccaggcccugcacggggccaaccuccgucaggacgacucaguccggaaccuguucgccagcgugaagucaagccaguccucacccaucauccccggcuucgggggcgacuucaaccuuacccuccuggagcccguguccaucagcaccggcuccagaagcgcgcgguccgccaucgaggaccuccuuuucgacaaggugacgauugccgacccgggguacaugcagggcuacgacgacugcaugcagcaggggcccgccagcgcccgcgaccuuaucugcgcgcaguacgucgccggcuacaaggugcugccgccccucauggacgugaacauggaggccgccuacaccagcucccuucuggggagcaucgcaggcgucggcuggaccgccgggcucuccagcuucgcugccauacccuucgcccaguccaucuuuuaccggcugaacggcguuggcaucacgcaacagguccugagcgagaaccagaagcucaucgcgaacaaguuuaaccaggcccuaggcgccaugcaaacgggguuuaccaccaccaacgaggcuuuccgcaaggugcaagacgcagugaacaacaacgcgcaggcgcuguccaagcucgccagcgagcuguccaacacguucggcgccaucagcgcauccauaggcgacaucauacagcgucuggacguccucgagcaggacgcccagaucgaccgccugaucaacgggcggcugaccacccuuaacgccuucgucgcccagcagcuggugcgcagcgaguccgccgcgcugagcgcccaguuagccaaggacaaggugaacgagugugucaaggcccaguccaagcggagcggcuucugcgggcaagggacccacaucguguccuucgucguaaacgcucccaacggccuguacuucaugcacgugggauacuauccaagcaaccacauagagguuguguccgcguacggccugugcgacgccgccaaccccacgaacugcaucgccccugugaacggauacuucaucaagaccaacaacacacgcaucgucgacgaguggagcuacacaggcagcuccuucuacgcccccgagcccaucacaagccucaacaccaaguacguggcgccucaggugaccuaccagaacaucuccaccaaccugccgccgccccugcucgggaacagcaccggcaucgacuuccaggacgagcuggacgaguuuuucaagaacgucuccacgagcauccccaacuucggcucccugacucagauuaacaccacccuccuggaccugacguacgagaugcucagccugcagcaggucgugaaggcccugaacgagucuuacaucgaccucaaggagcugggaaacuacaccuacuauaacaaguggcccugguacaucuggcugggguucaucgcagggcucguggcccuggcccugugcguguucuucauucucugcugcaccggcugcgggaccaacuguaugggcaagcucaagagcaaccggugcugcgaccgauacgaggaauacgaucuggagccccauaaagugcacguccacuga

SEQ ID NO: 1250 - RNA, 4062 nt, Artificial Sequence
  derived and/or modified CDS sequence (opt11) from MERS-CoV__AKN24830__S
augauccacagcgucuuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggagccgcggccaacucuaccgggaccguaaucaucucccccagcaccuccgccaccauccggaagaucuaccccgccuucaugcugggcagcuccguggggaacuucagcgacggcaagaugggccgcuucuucaaccacacgcucguccuucugccggacgggugcggcacccuccuucgggcguucuacugcauccuggagccccgcuccgggaaccacugccccgccggcaacagcuacaccuccuucgcuaccuaccacacgcccgccaccgacugcagcgacggcaacuacaaccggaacgccucccucaacagcuucaaggaguacuucaaccugcggaacugcacauucauguacaccuacaacaucacggaggacgagauccuggagugguucgggaucacccagaccgcgcagggcgugcaucucuucagcuccagauacguggaccuguacgggggcaacauguuccaguucgccacccugccggucuacgacacgaucaaauacuacagcaucaucccccacuccauccgcagcauccaguccgaccggaaggccugggccgccuuuuacguguacaagcuccagccccugaccuuucugcucgacuucucaguggacggguacauccgccgggcgaucgacugcggcuucaacgaccugucccagcugcacugcagcuacgaauccuucgacgucgagagcggcguguacuccgugagcuccuucgaggccaagcccagcggguccgucguggagcaggccgagggcguggagugcgacuucucuccgcuccuguccgggaccccgccccaagucuacaacuucaagcgccugguguucaccaacugcaacuacaacuucacgaagcuccugagcuuguucuccgucaacgacuucacgugcagccagaucagccccgccgcgaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccacaaucaccaagccgcugaaguacuccuacaucaacaagugcucgcggcugcuguccgacgaccgcaccgaggucccccagcuggugaacgccaaccaguacagccccugcguguccaucguccccagcacggugugggaagacggggacuacuaccggaagcagcugucgccgcucgagggcggcggguggcugguggcauccggccccaccgucgcgaugaccgagcagcugcagaugggguucggcaucaccgugcaguaugggacugacacgaacagcgugugccccaagcucgaguucgccaacgacaccaaaaucgccucccagcugggcaacugcgucgaguacagccuguacggcguguccgggaggggcguguuccagaacugcaccgccgucggcgugcggcagcagcgcuucguguacgacgcguaccagaaccucgucggcuacuacagcgacgacggcaacuacuacugcuugcgggccugcguguccgugcccgucagcgugaucuaugacaaggagaccaagacgcacgccacucuuuucgggucaguggccugcgagcacaucagcuccaccaugagccaguacucccgcagcacccgcuccaugcugaagcggcgcgacagcacguacggcccccuccagacacccgucgggugcgugcuaggacuggugaacuccagccucuucguagaggacugcaagcugccccugggacagucccucugcgcccugccggacacccccagcacccugacgccccgaagugugcgcuccguccccggcgagaugcggcucgcaagcaucgccuucaaccacccgauccaggucgaccagcuuaauuccagcuacuuuaagcuguccauccccaccaacuucagcuucggcgugacccaggaguacauacagaccacgauccagaaggugaccgucgacugcaagcaguacgugugcaacggguuccagaagugcgagcagcuccugcgcgaguacggccaguucugcuccaagaucaaccaggcccugcacggggccaaccuccggcaggacgacagcgugcgcaaccuguucgccuccgucaagagcucccagaguucccccaucauccccggcuucgggggcgacuucaaccugacccuccuggagccggucagcaucuccaccggcagcagguccgcgcgcagcgccauugaggaccuauuguucgacaaggugacgaucgccgaccccggauacaugcagggcuacgacgacugcaugcagcaggggcccgccuccgcccgggaccuaauuugcgcgcaguacgucgccggcuacaaggugcugcccccgcucauggacgugaacauggaggccgccuauaccagcagccuacugggguccauugcgggcgucggcuggaccgccgggcucagcuccuucgccgccauccccuucgcccagagcaucuucuaccgccugaacggcguggggaucacccagcagguccuguccgaaaaccagaagcucaucgcgaacaaguucaaccaggcccugggcgccaugcagacgggguucaccaccaccaacgaggccuuucggaaggugcaggacgccgugaacaacaacgcgcaggcccugagcaagcuggccuccgagcugucuaacacguucggcgccaucuccgccucgaucggcgacaucauccaacgccuggacgugcucgagcaggacgcgcaaaucgaccggcugaucaacgggcgccugaccacccucaacgccuucgucgcccagcagcuggugcgguccgagagcgcugcgcuguccgcccagcucgccaaggacaaggugaacgagugcgucaaggcccagagcaagcgcuccggcuucugcgggcagggcacccacaucgugagcuucgucgugaacgcccccaacggcuuguacuucaugcacgugggguacuaccccuccaaccacaucgaggucgugagcgcguacgggcugugcgacgccgccaacccgacgaacugcaucgcucccgugaacggguacuuuaucaagacaaacaacacccggaucgucgacgagugguccuauaccggcagcagcuucuacgcccccgagcccaucacgucccucaacaccaaguacguggcgccccaggugaccuaccagaacaucagcaccaaccugcccccgccgcuguuggggaacaguaccggcaucgacuuccaggacgaacuggacgaguuuuucaagaacgucagcacguccauccccaacuucggcagccugacccagaucaacaccacccuccuggaccugacguacgagaugcucagcuuacagcagguagugaaggcccugaacgagagcuacaucgaccugaaggagcuggggaacuacaccuacuacaacaaguggccgugguacaucuggcugggcuucaucgccgggcucguugcccuggcccugugcgucuucuucauccucugcugcaccgggugcgggaccaacugcaugggcaagcuaaagugcaaccgcugcugcgacagauacgaggaguacgaccuggagccccacaaggugcacguccacuga

SEQ ID NO: 1251 - RNA, 4062 nt, Artificial Sequence; identical to SEQ ID NO: 339
  derived and/or modified CDS sequence (opt11) from MERS-CoV__ALB08257__S

SEQ ID NO: 1252 - RNA, 4062 nt, Artificial Sequence; identical to SEQ ID NO: 340
  derived and/or modified CDS sequence (opt11) from MERS-CoV__ALB08311__S

SEQ ID NO: 1253 - RNA, 4062 nt, Artificial Sequence
  derived and/or modified CDS sequence (opt11) from MERS-CoV__ALB08322__S
augauccacagcguguuccugcucauguuccugcugacccccaccgaguccuacgucgacgugggcccugacagcgugaaguccgccugcaucgaggucgacauccagcagacguucuucgacaagaccuggccccgccccaucgacgugagcaaggccgacgggaucaucuauccccagggccggaccuacaguaacaucaccaucacguaccagggccucuucccguaccagggcgaccacggggacauguacguguacagcgcgggcuacgccaccggcaccacgccccagaagcuguucgucgccaacuacucccaggacgugaagcaguucgccaacggguucgugguccgcaucggcgccgcggccaacuccaccgggaccgugaucauaucccccagcaccuccgccaccauccggaagaucuaccccgccuucaugcugggcuccuccguggggaacuucagcgacggcaagaugggccgcuucuucaaccacacgcucguccugcugccggacgggugcggcacccuccugcgggcguucuacugcauccuggagccccgcagugggaaccacugccccgccggcaacagcuacaccaguuucgccaccuaccacacgccugccaccgacugcagcgacggcaacuacaaccggaacgccucccucaacagcuucaaggaguacuucaaccugcgcaacugcaccuucauguacaccuacaauaucaccgaggacgagauccuggagugguucgggaucacccagaccgcgcagggcgugcaccucuucagcucccgguacguggaccuguacggcggcaacauguuccaguucgccacccuuccggucuacgacacuaucaaguacuacagcaucaucccccacuccauccgcagcauccagucugaccggaaggccugggccgccuucuacguguacaagcuccagccccugaccuuccugcucgauuucagcguggacggguacauccgccgggcgaucgacugcggcuucaacgaccuaucccagcugcacugcagcuacgaguccuucgacgucgagagcggcguauacucggucagcuccuucgaggccaagcccagcggguccgucguggagcaggccgaggguguggagugcgacuucaguccgcuauuauccgggaccccgccccaggucuacaauuucaagcgccugguguucaccaauugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugacuaccaucaccaagccccugaaguacuccuacaucaacaaguguucucggcuccuguccgacgggcgcaccgaggugccccagcuggugaacgccaaccaguacagccccugcguguccaucguccccagcacggugugggaggacggcgauuacuaucggaagcagcucagcccgcuggagggcgggggcuggcucguggccuccggaagcaccgucgcaaugaccgagcaguugcagaugggcuucgggaucaccgugcaguacggcacugacacgaacuccgugugccccaagcuggaguucgccaacgacaccaagaucgccagccagcugggcaacugcgucgaguacucccuauacggggugagcggccgcgggguguuccaaaacugcaccgccgucggcgugcggcagcagcgcuucguguacgacgcguaccagaaccuggucggcuacuacuccgacgacgggaacuacuacugccugcgggccugcgugagugugcccgucuccgugaucuacgacaaggagaccaagacgcacgccacccuguucggcagcguggccugcgagcacaucuccagcaccaugucccaguacagccgcuccacccgcagcaugcucaagcggcgugacuccacguacgggccgcugcagacccccgucggcugcgugcuggggcucgugaacagcucccuguucgucgaggacugcaagcugccccucggccagagccugugugcccugcccgacaccccgagcacccucacgccccgguccguccgcagcgugcccggcgagaugcggcuggcauccaucgccuucaaccaccccauccaggucgaccagcugaacagcuccuacuucaagcuaagcaucccgaccaacuucuccuucggugugacccaggaguacauccagaccacgauccagaaggugaccgucgauugcaagcaguacgugugcaacggcuuccagaagugcgagcagcugcugcgcgaguacgggcaguucugcagcaagaucaaccaggcccuccacggcgccaaucugcggcaggacgacuccgugcgcaaccuguucgccuccgucaaguccagccaguccagccccaucauccccggguucggcggcgacuucaacuugacccugcuggagccaguguccaucagcaccggcucccggagcgcgagauccgccaucgaggaccuccucuucgacaaggugacgaucgccgauccgggcuacaugcaggguuacgacgacugcaugcagcagggccccgccagcgccagggaccugaucugugcccaguacgucgccggguacaaggugcucccgccccugauggacgugaacauggaggccgccuacaccagcucccugcucggcuccaucgcgggcguuggguggaccgccggccuguccagcuucgcggccauccccuucgcccaguccaucuuuuacagacugaacggggugggcaucacccagcagguccucagcgagaaccagaagcugaucgcgaacaaguucaaccaggcccugggggccaugcaaacgggauucaccaccaccaacgaggccuuccggaaggugcaggacgccgugaacaacaacgcgcaggcccucuccaagcuggcgagcgaacuguccaacacguucggcgccaucagcgcauccaucggugacaucauccagagacucgacgugcuggagcaggacgcgcagaucgaccggcugaucaacggccgccucaccacccugaacgccuucgucgcccagcagcuggugcggagcgaguccgccgcgcucagcgcccaguuagccaaggacaaggugaacgagugcgucaaggcccaguccaagcgcagcggguucugcggccagggcacccacaucguguccuucgucgugaacgcccccaacgggcuuuacuucaugcacgugggcuacuaccccucaaaccacaucgaggucguguccgcguacggccucugcgacgccgccaaccccacgaacugcaucgccccggugaacggauacuucaucaagaccaacaacacccggaucgucgacgaguggagcuacaccgggagcuccuuuuacgcccccgagcccaucacaagccugaacaccaaguacguggcgccccaggugaccuaccagaacaucuccaccaaccugccgccgccccuccugggcaacagcaccggaaucgacuuccaggacgagcuggacgaguucuucaagaacgucuccacgagcauccccaacuucgggucccucacccaaaucaacaccacccugcuggaccucacguacgagaugcugagccugcagcaggucgugaaggcccucaacgaguccuacaucgaccugaaagagcugggcaacuacaccuacuacaacaaauggcccugguacaucuggcucggguucauugccggccugguggcccuggcacucugcguguuuuucauccugugcugcaccgggugcggcaccaacugcaugggcaagcugaagugcaaccgcugcugcgaccgcuaugaggaguacgaccucgagcugcacaaggugcacguccacuga

SEQ ID NO: 1254 - RNA, 4062 nt, Artificial Sequence; identical to SEQ ID NO: 342
  derived and/or modified CDS sequence (opt11) from MERS-CoV__ALD51904__S

SEQ ID NO: 1255 - RNA, 4062 nt, Artificial Sequence
  derived and/or modified CDS sequence (opt11) from MERS-CoV__ALJ54446__S
augauccacagcguguuccugcucauguuucugcugacccccaccgaguccuacgucgacgugggcccggacagcgugaaguccgccugcaucgagguugacauccagcagacguucuucgacaagaccuggccccgccccaucgaugugucgaaggccgacggcaucaucuauccgcagggccggaccuacuccaacaucaccaucacguaccagggccucuucccguaucagggcgaccacggggacauguacguguacagcgcgggccacgcaaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccgugggcaacuucucggacggcaagaugggccgcuucuucaaccacacgcucgucuuacugccggacgggugcggcacccuccugcgggcuuucuacugcauccuggaaccccgcuccgggaaccacugccccgccggcaacuucuacaccucguucgccaccuaccacacgcccgccaccgacugcuccgacggcaacuacaaccggaacgcgagccucaacuccuucaaagaguacuucaaccugcgcaacugcaccuucauguacaccuacaacaucacggaggacgagauccuggagugguucgggaucacccagaccgcgcagggcgugcaccucuucagcagcagguacguggaccuguacggggguaacauguuccaguucgccacccugccggucuaugacacgaucaaguacuacuccaucauaccccacagcauccgcuccauacagagcgaccgaaaggccugggccgccuucuacguguacaagcuccagccccucaccuuccugcucgacuuuuccguggacggguacauucgccgggcgaucgacugcggcuucaacgaccugagccagcugcacugcuccuacgagagcuucgacgucgaguccggcguguacagcgugucgagcuucgaggccaagcccuccgggagcgucguggagcaggcagagggcguggagugcgacuucuccccgcuccugagcgggaccccgccccaggucuacaacuucaagcgccugguguucaccaacugcaacuacaaccucacgaagcugcugucccucuucagcgucaacgacuucaucugcucccagaucagccccgccgccaucgcgagcaacugcuacuccagucugauccuggacuacuucuccuacccccucagcaugaaguccgaccugagcguguccagcgccgggcccaucucccaguucaacuacaagcagagcuucuccaacccgaccugccugauccucgccaccgugccccacaaccugacuacgaucaccaagccccugaaguacagcuacaucaacaagugcucccggcuccugagcgacgaccgcaccgaggucccccagcuggugaacgccaaccaguacucccccugcgugagcaucguccccuccaccgugugggaggacggggacuacuaccggaagcagcucagcccgcuggagggcggcggguggcugguggccagcggcaguacggucgcuaugaccgagcagcuccagaugggcuucggaaucaccgugcaguacgggaccgauaccaacagcgucugccccaaguuagaguucgccaacgacacgaaaaucgccucccagcugggcaacugcgucgaguacagccucuacggcguguccgggcgcggcguguuccagaacugcaccgccgucggggugcggcaacagcgcuucguguacgacgcguaccagaaucuggucggcuacuacagcgacgacggcaacuacuacugccugcgggccugcguguccgugcccgucagcgugaucuacgacaaggagaccaagacccacgccacgcuguucggguccguggccugcgagcacaucagcuccaccaugagccaguacucccgcaguacccguuccaugcucaagcggcgcgacagcaccuacggcccacugcagacgcccgucgggugcgugcugggccucgugaacuccagccuguucgucgaggacugcaagcugccccucgggcagucccugugcgcccuucccgacaccccgagcacccucacgccccggagcgugcgcuccgugcccggcgagaugcggcuggcgagcaucgccuucaaccaccccauccaggucgaccagcugaacuccucguacuucaagcucuccaucccgaccaacuucagcuucggcguaacccaggaguacauccaaaccaccauccaaaaggugacggucgacugcaagcaguacgugugcaacggguuccagaagugcgagcagcugcugcgcgaguacggccaguuuugcuccaagaucaaccaggcccuccacggggccaaccuccggcaggacgauagcgugcgcaaccuguucgcauccguaaagagcucccagagcucccccaucauccccggcuucgggggcgacuucaaucucacccugcuggagcccgugagcauuuccaccggcagccgguccgcgcgcagcgccaucgaggaucuccuguucgacaaggugaccaucgccgacccgggguacaugcagggcuacgacgacugcaugcagcaggggcccgccuccgcccgggaccugaucugcgcgcaguacgucgccggcuacaaggugcucccgccccugauggacgugaacauggaggccgccuacacgagcagccugcucggguccaucgcgggcgucggcuggaccgccgggcugagcuccuucgccgccauccccuucgcccagagcaucuucuaccgccugaacggcguggggaucacccagcagguccucuccgagaaccagaagcugauugcgaacaaguuuaaccaggcccugggcgccaugcagaccggguucacgaccaccaacgaggccuuccggaaggugcaggacgccgugaacaacaacgcucaggcccucagcaagcuggccuccgagcugagcaacaccuucggcgccaucuccgccagcaucggcgacaucauccagcgccucgacgugcuggagcaggacgcgcagaucgaccggcugaucaacgggcgccucacgacucugaacgccuucgucgcccagcagcuggugcgguccgagagcgccgcgcucuccgcccagcuggccaaggacaaggugaacgagugcgucaaggcccagagcaagcgcuccggcuucugcgggcagggcacccauaucgugagcuucgucgugaacgcccccaacggacuguacuucaugcaugugggcuacuaccccuccaaccacaucgaggucgugagcgcguacggccucugcgacgccgccaaccccaccaacugcaucgccccggugaacggguacuucaucaagacgaacaacacccggaucgucgacgagugguccuacaccggcagcagcuucuacgcccccgagcccaucaccucccugaacacgaaguacguggcgccccaggugaccuaccagaacaucagcaccaaccucccgccgccacuccuggggaacuccaccggcaucgacuuccaggacgagcuggacgaguucuucaagaacgucagcaccuccauaccuaacuucggcagccucacgcagaucaacaccacccugcuggaccucaccuacgagaugcuguccuugcaacagguagugaaggcccucaacgagagcuacaucgaccugaaggagcuggggaacuacacguacuacaacaaguggcccugguacaucuggcucggcuucaucgccgggcugguggcccuggcccucugcguguucuucauccugugcugcaccgguugcgggaccaacugcaugggcaagcugaagugcaaccgcugcugcgaccgcuacgaggaguacgaccucgagccccacaaggugcacguccacuga

SEQ ID NO: 1256 - RNA, 4062 nt, Artificial Sequence; identical to SEQ ID NO: 344
  derived and/or modified CDS sequence (opt11) from MERS-CoV__ALJ54448__S

SEQ ID NO: 1257 - RNA, 4062 nt, Artificial Sequence; identical to SEQ ID NO: 345
  derived and/or modified CDS sequence (opt11) from MERS-CoV__ALJ54450__S

SEQ ID NO: 1258 - RNA, 4062 nt, Artificial Sequence
  derived and/or modified CDS sequence (opt11) from MERS-CoV__ALJ54453__S
augauccacagcguguuccugcucauguuccugcugacccccacugaguccuacgucgacguggguccggacagcgugaaguccgccugcaucgaggucgacauccagcagacguucuucgacaagaccuggccccgccccaucgacgugagcaaggccgacgggaucaucuacccccagggccggaccuacucuaacaucaccaucacguaucaaggccucuucccguaccagggcgaccacggggacauguacguguacagcgcgggccacgccaccggcaccacgccccagaagcuguucguugccaacuacucccaggacgugaagcaguucgccaacggguucgugguuagaaucggcgccgcggccaacagcaccgggaccgugaucaucucccccagcaccucggccaccauccggaagaucuaccccgccuucaugcugggcucguccguggggaacuucagcgacggcaagaugggccgcuucuucaaccacacgcucguccugcugccggacgggugcggcacccuccugcgggcguucuacugcauccuggagccccgcuccgggaacuacugccccgcgggcaacucguacaccaguuucgccaccuaccacacgcccgccaccgacugcagcgacggcaacuacaaccggaacgccucccucaacagcuucaaggaguauuucaaccugcgcaacugcaccuucauguacacuuacaacaucaccgaggacgaaaucuuggagugguuugggaucacccagaccgcgcagggcgugcaccucuuuagcucccgguacguggaccuguacgggggcaacauguuccaguucgccacccugccggucuacgacacgaucaaguacuacucaaucaucccccacaguauccgcagcauucaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaagccgagggcguggagugcgacuucagcccgcuccuguccgggaccccgccccaggucuacaacuucaagcgccugguguucaccaacugcaacuacaaucucacgaagcugcugagccucuucuccgucaacgacuucacgugcagccagaucagccccgccgccaucgcguccaacugcuacagcucccugauccuggacuacuucagcuaccccuuauccaugaaguccgacuugagcgugagcuccgccgggcccaucagccaguucaacuacaagcaguccuucagcaacccgaccugccugauccucgccaccgugccccacaaccugaccaccauuaccaagccccugaaauacuccuacaucaacaagugcagccgguugcuguccgacgaccgcaccgaagucccccagcuggugaacgccaaccaguacucucccugcguguccaucguccccagcacggugugggaggacggggacuacuaccggaagcagcucagcccgcuggagggcggcggguggcugguggccuccggcagcaccgucgcgaugaccgagcagcuccagaugggcuucggcaucaccgugcaguacgggaccgacacgaacagcgugugccccaagcuggaguucgccaacgacaccaagaucgccucacagcugggcaacugcgucgaguacucccucuacggcgugagcgggcgcggcguguuccagaacugcaccgccgucggagugcggcagcagcgcuucguguacgacgcguaccagaaccuggucggcuauuacuccgacgacggcaacuacuacugccugcgggccugcgugagcgugcccgucuccgugaucuacgacaaggagaccaagacgcacgccacccuguucgggagcguagccugcgagcacaucuccagcaccaugucccaguacagccgcuccacccgcagcaugcucaaacggcgcgacuccacguacggcccgcugcagacccccgucgggugcgugcugggcuuagugaacagcucccuguucgucgaggacugcaagcugccccucgggcagagccucugcgcccugcccgacaccccgaguacccucacgccccgguccgugcgcaguguccccggcgagaugcggcuggcguccaucgccuucaaccaccccauccaggucgaccagcugaacagcucuuacuucaagcucuccaucccgaccaacuucuccuucggcgugacccaggaguacauccagaccacgauccagaaggugaccgucgacugcaaacaguacgugugcaacggguuccagaagugcgaacaacugcugcgcgaguacggccaguucugcagcaagaucaaccaggcccuccacggggccaaccugcggcaggacgacuccgugcgcaaccuguucgccagcgucaaguccagccaauccagccccaucaucccaggcuucgggggcgacuucaaccucacccugcuggagcccguguccaucagcaccggcucccggagcgcgcgcuccgccaucgaggaccuccuguucgacaaggugacgaucgccgacccgggguacaugcagggguacgacgacugcaugcagcaggggcccgccagcgcccgggaccugaucugcgcgcaguacgucgccggcuacaaggugcucccgccccugauggacgugaacauggaagccgccuacaccagcucccugcuagggagcaucgcgggcgucgguuggaccgccggucuguccagcuucgccgcgauccccuucgcccaguccaucuucuaccgccugaacggcguggggaucacccagcagguccucagcgagaaccagaagcugaucgcaaacaaguucaaccaagcccugggcgccaugcagacgggguucaccaccaccaacgaagccuuccggaaggugcaggacgccguaaacaacaacgcgcaggcccucuccaagcuggccagcgagcuguccaacacguucggcgccaucucggccuccauuggggacaucauccagcgccucgacgugcuggagcaggacgcgcagaucgaccggcugaucaacgggcgccucaccacccugaacgccuucgucgcccagcaacuggugcggagcgaguccgccgccuuaagcgcccagcuggccaaggauaaggugaacgagugcgucaaggcccaguccaagcgcucgggcuucugcgggcagggcacccacaucguguccuucgucgugaacgcccccaacggcuuauacuucaugcacgugggguacuacccgagcaaccacaucgaggucguguccgcuuacgggcucugcgacgccgccaaccccacgaacugcaucgccccggugaacggguacuucaucaagaccaacaacacccggaucgucgacgaguggucuuauaccggcagcucuuucuacgcccccgagcccaucacgagccucaacaccaaguacguggcgccccaggugaccuaccagaacaucuccaccaacuugccgccgccccugcuggggaacagcaccggcaucgacuuccaggacgagcuggacgaguucuucaagaauguguccacgagcauccccaacuucggcucccucacccagaucaacaccacccugcuggaccucacguacgagaugcugagccugcagcaggucgugaaggcccucaaugaguccuacaucgaccugaaggagcuggggaacuacaccuacuacaacaaguggcccugguacaucuggcucggguucaucgccgggcugguggcccuggcccucugcguguucuucauccugugcugcaccggcugcgggaccaacugcaugggcaagcugaagugcaaccgcuguugcgaccgcuacgaggaguacgaccucgagccccacaaggugcacguccacuga

SEQ ID NO: 1259 - RNA, 4062 nt, Artificial Sequence
  derived and/or modified CDS sequence (opt11) from MERS-CoV__ALJ54455__S
augauccauagcguguuucugcucauguuccugcugacccccaccgaguccuacgucgacgugggcccggacagcgugaaauccgccugcaucgccgucgacauacagcagacuuucuucgacaagaccuggccccgccccaucgacguaagcaaagccgaugggaucaucuacccccagggccgaaccuacucgaacaucacaaucacguaccagggccucuuccccuaccagggcgaccacggggacauguauguguacagcgccggccacgccaccggcaccacgccccagaagcuguucgucgccaacuacucccaagacguuaaacaguucgccaacgguuucgugguccgcauaggcgcggccgccaacagcaccgguaccgugaucaucuccccgagcacguccgccaccauccggaagaucuaccccgcguucaugcugggaagcuccguggggaauuuuagcgacggcaagaugggccgguucuucaaccacacacucguccugcucccggacgguugcggcacccuccugcgggccuucuacugcauccuggagccccgcuccgggaaccacugccccgccgguaacagcuacaccuccuucgcuaccuaccauacgcccgcaacugacugcagcgacggcaacuacaaccggaacgcgucccucaacucauucaaggaguacuucaaccugaggaacugcaccuucauguauaccuacaacauuacggaggacgagauccuggagugguuugggaucacgcagaccgcccagggcgugcaccucuucagcucccgguacguggaccuguacggaggcaacauguuccaguucgccacccuaccggucuacgacacgaucaaguacuacucuaucauuccccacuccauccgcagcauccaguccgaccggaaggccugggccgcguucuacguguacaagcuccagccccugaccuuccugcucgacuuuagcguggacggguacauccgccgggcaauagacugcggcuucaacgaccucucccagcugcauugcagcuacgaguccuucgacgucgagucaggcguguacuccgugagcucuuucgaagccaagcccagcggguccgucguagagcaggccgaaggcguggagugcgacuucagcccgcuucucuccgggacaccgccccaggucuacaacuuuaagcgccugguguucaccaacugcaacuacaaccucacgaaacugcugagccucuucuccgucaacgacuucacgugcagccagauaagccccgccgccaucgccuccaacugcuacagcucccugauccuggacuacuucagcuaccccuuauccaugaaguccgaccugagcgugagcucugccgggccuaucucacaguucaauuacaagcaguccuucagcaacccgaccugccugauccucgccaccgugccccacaaccugaccaccauuaccaagccccugaaguacuccuacaucaacaagugcucgcggcuccuguccgacgaccgcaccgagguuccccagcuggugaacgccaaucaguacagccccugcguguccaucguccccagcacggugugggaggacggggacuacuaucggaagcagcucagcccacuggagggaggcggguggcugguggcgagcggcagcaccgucgccaugaccgagcagcuccaaaugggguucgguaucaccgugcaguacgggaccgacacgaacuccgugugcccgaagcuggaguucgccaaugacaccaagaucgccucccagcugggaaacugcguugaguacucccucuacggcgugagcgggcgcggcguguuccagaacugcaccgcggucggggugcggcagcagagguucguguacgacgccuaccagaaccuagucggcuacuacuccgacgacgguaacuacuacugccugcgggccugcgugagcgugcccguauccgugaucuacgacaaggagaccaagacgcacgccacccuguucgggagcguggccugcgagcacauuucaagcaccaugucccaauacagccgcuccacccgcagcaagcucaagcggcgcgacuccacguacggcccgcugcagaccccugucgggugcguucugggccucgugaacagcucgcuguucgucgaggacugcaagcugccacucggacagagccugugcgcgcugccugacacgccgagcacgcucaagcccagguccgugcgcagcgugcccggcgagaugcggcuggcuuccaucgccuucaaucaucccauacaagucgaccagcucaacucaucuuauuucaagcucaguaucccaacgaacuucagcuucggcgugacccaggaguacauccagaccaccauccagaaggugacggucgauugcaagcaguacguguguaacggguuccagaagugcgagcagcugcugcgcgaguacggccaguucugcagcaagaucaaccaggcccuccauggagccaaccuacggcaggacgacuccgugcggaaccuguucgcgagcgucaaguccagccaguccagccccaucauaccaggcuucgggggcgacuucaaucuuacccugcuggagcccguguccaucagcaccggcucccggagcgcccgcuccgccaucgaggaccuccuauucgacaaggugacaaucgccgacccgggguacaugcagggcuacgacgacugcaugcagcaggggcccgccuccgcgcgggaccugaucugcgcccaguacgucgccggcuacaagguacucccgccccugauggacgugaacauggaggccgcguacacgagcucccugcucgggagcauagccggagucggcuggaccgccgggcuguccagcuucgccgccauccccuucgcgcaguccaucuucuaccgccugaacggcgucggaaucacccagcagguccucagcgagaaucagaaauugaucgccaacaaguucaaccaggcccuaggcgccaugcagaccggguucacuaccaccaacgaggccuuccggaaggugcaggacgcggugaacaacaacgcccaggcccucuccaagcuggccagcgagcuguccaacaccuucggcgcaaucagcgcgaguaucggcgacaucauccagcgccucgacgugcuggagcaggaugcccaaauagaccggcugaucaacgggcgccucacgacccugaacgccuucgucgcccagcaguuggugcggagcgaguccgcggcccuuagcgcucagcuggccaaggacaaggugaacgagugcgucaaggcccaguccaagcgcagcggcuucugcgggcagggcacccacaucgugaguuucgucgugaacgcgcccaauggccuguauuucaugcacgugggguacuaccccagcaaccacaucgagguaguaagcgccuacggccucugcgacgccgccaaccccaccaauuguaucgccccggugaacggguacuucaucaagacgaacaacacccggaucgucgacgaauggucuuacaccggcagcuccuucuacgccccagagcccaucaccagccugaacacuaaguacguggcgccccagguuaccuaccagaacaucuccacaaaccugcccccgccccuccuggggaacucgaccggcaucgacuuccaggacgagcuggacgaguucuucaagaacgucuccaccagcauccccaauuucgguucccucacucagaucaacaccacccugcuggaccucaccuacgagaugcugagccugcagcaggucgucaaggccuugaacgaguccuacaucgaccugaaggagcuggggaacuacacguacuacaacaaguggcccugguacaucuggcucggcuucaucgccgggcugguggccuuggcccucugcguguucuucaucuugugcugcaccggcugcgggaccaacugcaugggcaagcugaagugcaaccgcugcugcgaccgcuacgaggaguacgaccucgagccccacaaggugcacguccacuga

SEQ ID NO: 1260 - RNA, 4062 nt, Artificial Sequence
  derived and/or modified CDS sequence (opt11) from MERS-CoV__ALJ54456__S
augauccacagcguguuccugcucauguuccugcuuaccccuaccgaguccuacgucgacgugggaccggacagcgugaaguccgcguguaucgccgucgacauccagcagacguucuucgacaagaccuggccccgccccaucgacgugagcaaggcggacgggauaaucuacccccagggccggaccuacuccaacaucacgaucacguaccagggccucuucccauaccagggugaccacggggauauguacgucuacagcgccggccaugccaccggcacaacgccucagaagcuguucgucgccaacuacucccaggacgugaagcaguucgccaacggguucgugguccgcaucggcgcggccgccaacagcaccgggaccgugauuaucucccccagcaccuccgccaccauccggaagaucuaccccgccuucaugcucgguagcuccguggggaacuucagcgacggcaagaugggccgcuucuucaaucacacgcucguccugcugccggacgggugcggcacccuccuucgagccuucuauugcauccuggagccccgcagugguaaccacugccccgccggcaacagcuacacauccuuugccaccuaccacacgcccgccacugacugcagcgauggcaacuauaaccggaacgcgucccuaaacagcuucaaggaguauuucaacuuaaggaacugcaccuucauguacaccuacaauaucacggaggaugaaauccuggagugguuugggaucacccagaccgcccaaggcguccaccucuucuccucccgguacguggaccuguacgggggcaacauguuccaguucgccacccugccggucuacgacacgaucaaguacuacagcaucaucccccacuccauccgcuccauccaguccgaccggaaggccugggccgcuuucuacguguacaagcuccagccccugacauuccugcucgacuuuagcguggacggguacauccgucgggccauugauugcggauucaacgaccugucccagcugcacugcucauacgaguccuucgacgucgagagcggcguguacuccguuagcuccuucgaggccaagcccagcggguccgucguggaacaagccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucucccccgccgcgaucgccuccaacugcuacagcucccugauccuugacuacuucagcuacccccucuccaugaaguccgaccugagcguguccuccgccgggcccaucucccaauucaacuacaagcaguccuucagcaauccuaccugccugauccucgccaccgucccccacaaccugaccaccaucaccaagccccugaaguacuccuacaucaacaagugcagccggcuccuguccgaugaccgcaccgaagucccgcagcucgugaacgccaaucaguauagccccugcguguccaucguccccagcacagugugggaggacggggacuacuaccggaagcagcucagcccccuggaggguggcggauggcugguggcguccggcagcacggucgccaugaccgagcagcuccagaugggguucggcaucacugugcaguaugggaccgacacgaacuccgugugccccaagcuggaguucgccaacgacaccaagaucgccagccagcugggcaauugcgucgaauacucccucuacggggucuccggucgcggcguguuccagaacugcaccgcggucggggugcgacagcagcgguucguguacgacgccuaccagaaccuggucggcuacuacuccgacgacggcaacuacuacugccugcgggccugcgugagcgugcccgucuccgugaucuacgauaaggagaccaagacgcacgccacacuauucgggagcguggcaugugagcacaucuccagcacaaugagccaguacagccgcuccacccgaagcaugcucaagcggcgcgacuccacguacggcccgcugcagaccccagucgggugcgugcugggccucgugaacagcucccuguucgucgaggacugcaaguuacccuuggggcagagccugugugcucugccagacaccccgagcacccucaagccccgguccgugcgcagcgugccgggugagaugcggcuggccuccaucgccuucaaccaccccauccaggucgaccagcugaacagcuccuacuucaagcucagcaucccaacaaauuucuccuucggcgugacccaggaguacauccagaccaccauccagaaggugacggucgacuguaaacaguacgugugcaacggguuccaaaagugcgaacagcugcugcgcgaguacgggcaguucugcucuaagaucaaucaggcgcuccacggggccaaccugcggcaggacgacuccgugcgcaaucuguucgcgagcgucaaguccagccaguccagccccaucaucccaggauucgggggcgacuucaaccucacccugcuggagcccguguccaucagcaccggaucucggagcgcccgcuccgccaucgaggaccuccuguucgacaaggugaccaucgccgacccgggauacaugcagggcuaugacgacugcaugcagcaggggcccgccagcgcgcgggaccugaucugcgcccaguacgucgcgggcuacaaggugcucccgccccugauggacgugaacauggaggccgcguacacgagcucccugcucgggagcauugccggcgucggcuggaccgccgggcuguccagcuucgccgccauccccuucgcgcaguccaucuucuaccgccugaacggcguggggaucacccagcagguacucagcgagaaccagaagcugaucgccaacaaguucaaccaagcccugggcgccaugcaaaccggcuucacgaccaccaacgaggccuuccggaaagugcaggacgcggugaacaacaacgcccaggcccuguccaagcuggccucagagcuguccaauacguucggcgccauaagcgcguccaucggcgacaucauccagcgccucgacgugcuggagcaggacgcccagauugaccggcugaucaacgggagauugacuacccugaacgccuuugucgcccagcagcugguucggagcgaguccgcggcccucagcgcccagcuggccaaggacaagguaaacgaaugcgucaaggcccaguccaagcgcagcggcuucugcgggcagggcacccacaucguguccuucgucgugaacgcgcccaacggccuguacuucaugcacgugggguacuaccccagcaaccacaucgaggucguguccgccuacggccucugcgaugccgcaaaccccaccaacugcaucgcuccgguuaauggguacuucaucaagacgaacaauacccggaucgucgacgaguggagcuacaccggcucauccuucuacgcgcccgagcccaucaccagccugaacacaaaguacguggcgccccaggugaccuaccagaacaucuccaccaaccugccaccgccccuccuggggaacagcaccggcaucgauuuccaggaugagcuggacgaguucuucaagaacgucuccaccagcaucccaaacuucggcucccucacgcagaucaacaccaccuugcuggaccucaccuacgagaugcugagccugcagcaggucgugaaggcccucaacgaguccuacaucgaccugaaggagcuggggaacuacacguacuacaacaaguggcccugguacaucuggcugggcuuuauugccgggcugguggcccuggcccucugcguguucuucauccugugcugcaccggaugcgggaccaacugcaugggcaagcugaagugcaaccgcugcugcgaccgcuacgaagaguacgaccucgagccccacaaggugcacguccacuga

SEQ ID NO: 1261 - RNA, 4062 nt, Artificial Sequence; identical to SEQ ID NO: 349
  derived and/or modified CDS sequence (opt11) from MERS-CoV__ALJ54461__S

SEQ ID NO: 1262 - RNA, 4062 nt, Artificial Sequence
  derived and/or modified CDS sequence (opt11) from MERS-CoV__ALJ54468__S
augauccacagcguuuuccugcucauguuuuuacugacccccaccgaguccuacgucgacgugggcccggacagcgugaaguccgccugcaucgaggucgacauccagcagacguucuuugacaagaccuggccccgccccaucgacgugagcaaggccgaugggaucaucuauccccaggggcggaccuacucgaacaucaccaucacguaucagggccucuucccguaccagggcgaucacggggacauguacguguacagcgcgggccaugccaccggcacgacgccccagaagcuguucgucgccaacuacucccaggacguaaagcaguucgccaacggguucgugguccgcaucggcgcggcggcuaacucuaccgggacugugaucaucucccccagcacguccgccaccauccggaagauauaccccgcuuucaugcugggcagcuccgucgggaacuucagcgacggcaagaugggccgcuuuuucaaccacacgcucguccugcuuccggacgggugcggcacccuccugcgggcguucuacugcaucuuggagccucgcuccgggaaccacugccccgccggcaacagcuacaccuccuucgccaccuaccacacgcccgccaccgacugcagcgacggcaauuacaaccggaacgccucccucaacaguuucaaggaguacuucaacuuacgcaacugcaccuucauguacaccuacaacaucacggaggacgagauccuggagugguuuggcaucacccagaccgcgcagggcguccaccucuucagcucccgguacgucgaccuuuacggugggaacauguuccaauucgcaacccugcccgucuacgacacaaucaaauacuauagcaucauaccccacuccauccggagcauccaguccgaccggaaggccugggccgccuucuacguguacaagcuccagcccuuaaccuuccugcucgacuucagcguggacggguacauccgucgggccaucgacugcggcuucaacgaucugucacagcuacacuguagcuacgaguccuuugacgucgagagcggcguguacuccgugagcuccuucgaggccaagcccagcggguccgucguggagcaggcagaggguguagagugcgacuucagcccguuacuguccgggaccccgccccaagucuacaacuucaagcgccugguguucaccaauugcaacuacaaccuaacgaagcugcugagucucuucuccgucaacgacuucaucugcagccaaaucagccccgccgccaucgcguccaacuguuacagcucccugauccuggacuacuucagcuacccccucuccaugaaguccgaccugagcgucagcuccgcuggacccaucagccaguuuaauuacaagcaguccuucagcaacccgaccugccucauccucgccaccgugccccacaaucugaccacaaucaccaagccccugaaguacuccuacauuaacaagugcagccggcuccuguccgacgaccguaccgaggucccccagcuggugaacgccaaccaguacagccccugcguguccaucguccccagcaccgugugggaggacggggacuacuaucggaagcagcucucgccccuggaaggcggcggguggcugguggccuccggcagcacggucgcgaugaccgaacagcuccagauggguuucggcaucaccgugcaguacgggaccgacaccaacucagugugccccaagcuggaguucgccaacgauacgaagaucgccagccagcugggcaacugcgucgaguacucacuguacggcgugagcgggcgcggcguuuuccagaacugcaccgccguuggggugcggcagcagagauucguguacgacgcguaccagaaccucgucggcuacuacuccgacgacggcaacuauuacugccugcgggccugcguuagcgugcccgucuccgugaucuacgacaaagagaccaagacacacgccacgcuguucgggagcguggccugcgagcacaucuccagcaccaugucccaguacagccgcuccacccgcagcaugcucaagcggcgcgacuccaccuacggcccucugcagacacccgucgggugcgugcugggccucgucaacagcucccuguucgucgaggacugcaagcugccccuagggcagagccugugcgcgcugcccgacaccccaagcacccucacgcccagaucagugcgcuccgugccuggcgagaugcggcuggcguccaucgccuucaaccaccccauccaggucgaccagcugaacagcucauacuucaagcucagcaucccgaccaacuuuagcuuuggcgugacccaggaguauauccagacuaccauccagaaagugacgguagacugcaagcaguacguuugcaacggguuccagaagugcgagcagcuccugcgcgaguauggccaguucuguucaaagauaaaccaggcccuccacggcgccaaccugcggcaggacgacagcguucgcaaccuguucgccagcgucaaguccagccaguccucccccaucauccccggcuucgggggcgacuucaaccucacgcugcuggagcccguguccaucucgaccggcucccggagcgcgcgcuccgccauagaggaccuccuguucgacaaggugaccaucgccgacccgggguauaugcagggcuacgacgacugcaugcaacaggggcccgccagcgcccgggaccugaucugcgcgcaauaugucgccggcuacaaggugcucccgccccugauggacgugaauauggaggccgccuacacgagcucccugcucggaagcaucgcgggugucggauggaccgcugggcugagcagcuucgccgccaucccauucgcccaguccaucuucuaccgccugaacggcguggggaucacccaacagguccucucagagaaccagaagcugaucgcgaauaaauucaaccaggcccugggcgccaugcagaccggguucacgaccaccaacgaggccuuucggaaggugcaggacgcagugaacaacaacgcgcaagcccucucgaagcuagccagcgagcuguccaacaccuucggcgccaucagcgccuccaucggcgacauuauccagcgccucgacguacuggagcaggacgcgcagauugaccgccugaucaacgggcgccucacaacgcugaacgccuucgucgcccagcagcuggugcggagcgaguccgcagcgcucuccgcccagcuggccaaggauaaggugaacgagugugucaaggcccaguccaagcgcagcggcuucugcgggcaaggcacccauaucguauccuuugucgugaacgcccccaacggccuguacuucaugcacguugguuacuaccccagcaaccacaucgaggucguguccgcguacggccucugcgacgccgcgaaccccacuaacugcaucgcaccggugaacggguacuucaucaagacgaacaacacccggaucgucgacgaguggagcuauaccggcagcuccuucuacgcccccgagcccaucaccagccugaacacgaaguacguggcgccccaggugaccuaccagaacaucuccaccaaccugccgccgccccuccuggggaacagcacuggcaucgacuuccaggacgagcuggacgaguuuuucaagaacgucucaaccagcauccccaacuucggcagucucacgcagaucaacaccacccugcuggaccucaccuacgagaugcugagcuuacagcaggucgugaaggcccucaacgaguccuacaucgacuuaaaggagcuggggaacuacacauacuacaauaaguggccuugguacaucuggcucggcuucaucgccgggcugguggcccuggcccucugcguguucuucauccugugcugcaccggcugcgggaccaacugcaugggcaaacugaagugcaaccgcugcugcgaccgauacgaggaguacgaucucgagccccacaaggugcacguccacuga

SEQ ID NO: 1263 - RNA, 4062 nt, Artificial Sequence
  derived and/or modified CDS sequence (opt11) from MERS-CoV__ALJ54471__S
augauccacagcguguaccuccucauguuucugcugacccccacugaauccuacgucgacgugggcccggacagugugaaguccgccugcaucgaggucgauauccagcagacguucuucgacaagaccuggccccgccccaucgacgucagcaaggcggacgggauuaucuacccccaaggccggaccuauuccaacaucaccaucacguaccagggccucuucccguaccagggcgaccacggggacauguacguguauucugcggggcacgccaccggcaccacgccccagaagcuguucgucgccaacuacucccaggacgugaagcaguucgccaacggguucgugguccgcaucggcgccgcggccaauucgaccggaaccgugaucaucucgcccucaacauccgccaccauccggaagaucuaccccgccuuuaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgccucccucaacucuuucaaggaguacuucaaccugcgcaacugcaccuucauguacaccuacaacaucacagaggacgagauccuggagugguucgggaucacccagaccgcgcagggcgugcaccucuucagcucccgguacgucgaccuguacggcgggaacauguuccaguucgccacccugccggucuacgacacgaucaaguacuacagcaucaucccccacuccauccgcagcauccaguccgaccggaaggccugggccgccuucuacguuuacaagcuccagccccugaccuuccugcucgacuucagcguggacggguacauccgccgggcgaucgacugcggguucaacgaccugucccagcugcacugcagcuacgaguccuucgacgucgaguccggcguguauuccgugagcuccuuugaggccaaacccagcggguccgucguggagcaggccgagggcguggagugcgacuucagcccgcuccuguccgggaccccgccccaggucuacaacuuuaagcgccuaguguucacaaacugcaacuacaaccuuaccaagcugcuaucacucuucuccgucaacgacuucacgugcagccaaauuagcccagccgccauugcguccaacugcuacagcucccugauccuggacuacuucagcuaccccuuauccaugaaguccgaccugagcgugagcuccgccgggcccaucagccaguucaacuacaagcaguccuucagcaacccgacaugucugauccucgccaccgugccccacaacuuaaccaccauaaccaagccgcugaaguauuccuacaucaacaagugcagccggcuccugagugacgaucgcaccgaggucccccagcuggugaacgcuaaccaguacagccccugcguguccaucguccccagcacggugugggaggacggggacuacuaccggaagcagcucagcccgcuggagggcggcggguggcugguugccuccggcagcaccgucgcgaugacugagcagcuccagaugggguucggcaucaccgugcaguacgggaccgacacaaacuccgugugccccaagcuggaguuugccaacgacaccaagaucgccagccagcuggguaacugcgucgaguacucccuguauggagugagcgggcgcggcguguuccagaacugcaccgccgucggggugcggcagcagcgcuucguguacgacgcguaccagaaccuggucggcuacuacuccgacgacggcaacuacuauugccugcgggccugcgugagcgugcccguauccgugaucuacgauaaagagaccaagacgcacgccacccuguucgggagcguggccugugagcacaucuccagcaccaugucccaguauagccgcuccacccggagcaugcucaagcggcgcgacuccacguacggcccgcugcaaaccccugucgggugcgugcugggcuuggugaacagcucccuguucgucgaggacugcaagcugccccucggccagagccugugcgcccugcccgauaccccaagcacccucacuccccgguccgugcgcagcgugcccggcgagaugcggcuggcguccaucgccuucaaccaccccauccaggucgaccaacugaacagcuccuacuucaagcucagcaucccgaccaacuucuccuuuggcguuacccaggaguacauccagaccacgauccagaagguuaccgucgacugcaagcaguacguguguaacggguuccagaagugcgagcagcugcugcgggaguacggccaguucugcagcaagaucaaccaggcccuccacggggccaaccugcggcaagacgacuccguacgcaaccuguucgccagcgucaaguccucacaguccagcccgaucauccccggcuuugggggcgacuucaaccucacccugcuggagcccguguccaucagcacgggcucccggucagcgcgcuccgccaucgaggaccuccuguucgacaaaguaacgauugcagacccgggguacaugcagggcuacgaugacugcaugcagcagggucccgccagcgcccgugaccugauuugcgcucaguacgucgccggcuacaaggugcucccgccccugauggacgugaacauggaagccgccuacaccagcucguugcucggaagcaucgcgggcgucggcuggaccgccgggcuguccuccuucgccgccauccccuucgcucaguccaucuucuaccgccugaacggcgugggcaucacccagcagguccucagcgagaaccagaaacuuaucgcgaacaaguuuaaccaggcccugggcgccaugcagacgggguucaccacuaccaacgaggccuuccgaaagguccaggacgccgugaacaacaacgcgcaggcccucuccaagcuggccucugagcuguccaacacguucggcgcuaucagcgcuuccaucggcgacauuauccagcgccucgacgugcuggagcaggacgcgcagaucgaccggcugaucaacgggcggcucaccacccugaacgccuucgucgcgcagcagcuggugcgcagcgaguccgccgcgcucagcgcccaguuggccaaggacaagguaaacgagugcgucaaggcccaguccaagcgcagcggcuucugcgggcagggcacccacaucguguccuucgucgugaacgcccccaacgggcuuuacuucaugcaugugggguacuaucccucgaaccacaucgaggucgugagcgcguacgggcucugcgacgccgccaaccccacgaacugcaucgccccggugaacggguacuucaucaagaccaacaacacccggaucgucgacgaguggagcuacaccggcagcuccuucuacgccccagagcccauaacgagccugaacaccaaguacguagcgccccaggugaccuaccagaacaucuccaccaacuugccgccuccccuccugggaaacagcaccggcaucgacuuccaagacgagcuggacgaguuuuucaagaaugucuccacgucaauccccaacuucggcucccucacccacaucaacaccacccuacuggaccucacguacgagaugcugucacugcagcaggucgugaaggcccugaacgagucuuacaucgaccugaaggagcuggggaacuacaccuacuacaacaaguggcccugguacaucuggcucggcuuuaucgccgggcugguggcccuggcccucugcguguucuucauccugugcugcaccgguugcgggacuaacugcaugggcaagcugaaguguaaccgcugcugcgaccgcuacgaggaguacgaucucgagccccauaagguucacguccacuga

SEQ ID NO: 1264 - RNA, 4062 nt, Artificial Sequence; identical to SEQ ID NO: 352
  derived and/or modified CDS sequence (opt11) from MERS-CoV__ALJ54472__S

SEQ ID NO: 1265 - RNA, 4062 nt, Artificial Sequence
  derived and/or modified CDS sequence (opt11) from MERS-CoV__ALJ54474__S
augauccacagcguguuccuguuaauguuccugcugaccccaaccgaguccuacgucgacguuggcccagacagcgugaaguccgccugcaucgaagucgacauccagcaaaccuucuucgacaaaacauggccccgcccuauagacgugagcaaggccgacgggaucaucuacccccagggccggaccuacuccaacauaaccauaacguaucagggccuauuucccuaccagggggaccacggggacauguacguguacuccgcgggccacgccacgggcacaacuccccagaaauuauucguugccaacuacucccaggacgugaagcaguucgccaacggguuugugguccgcaucggcgcugcggccaauagcacugggaccgugauaauuuccccaagcaccuccgcgaccauccggaagauauaccccgccuucaugcuaggcucauccgugggcaacuucagcgacgguaagaugggccgcuucuucaaccacacgcuuguacugcugccugacgggugcggcacccuccugcgggcguucuacugcauccuggaaccccgcuccgggaaccacugccccgccggaaacagcuacaccucguucgcuaccuaccacacgcccagcaccgacuguuccgacggcaacuacaaccggaacgccagccuaaauagcuucaaggaauacuucaaccugcgcaauugcaccuucauguacaccuacaacaucacggaggacgaaauccuggagugguucgggaucacacagacggcccagggcgugcaccucuucuccagccgguacguggaccuguacggcggcaacauguuccaauucgcgacccugccggucuacgacacgaucaaguauuacuccaucaucccccauagcauccgcuccauccagagcgacagaaaggccugggccgcguucuacguguauaagcuccaaccccugacuuuccuucucgauuucuccguggauggguacauccgccgagccaucgacugcggcuucaacgaucuuagccaauuacacugcuccuacgagucguucgacguugaguccggcguguacagcguguccagcuucgaggcgaagcccuccgggagcgucgucgagcaggccgaaggcguggagugcgacuucuccccgcuccugagcgggaccccgccccaggucuacaauuucaagcgccugguuuucaccaacuguaacuacaaccucacaaagcugcucucccucuucagcgucaaugacuuuacgugcucacagaucucccccgccgccaucgccucuaacugcuacuccagccugauccuggacuacuucuccuacccccucaguaugaagagugaucugagcguauccagcgcggggcccaucucccaguucaacuacaagcagagcuucagcaacccgaccuguuuaauccucgcaaccguuccccacaaccugaccaccaucaccaagccccuuaaguacaguuacaucaacaaguguucccggcuccugagcgacgaccgcaccgaggucccccaacuggugaacgccaaccaauacuccccuugcgucagcaucguccccucgacggugugggaggacggggacuacuaccggaagcagcucuccccgcucgagggcggcgggugguuaguagccagcggcuccaccgucgccaugaccgagcagcuccagaugggguucggcaucaccgugcaguacgggaccgacacgaacagcgucugccccaagcuggaguucgcgaaugacaccaagaucgcaagccagcugggcaacugcgucgaauacagccuguacggcguauccgggcgcggcguguuccagaacuguaccgccguuggggugcggcagcagcgcuucguguacgacgccuaccaaaaccuggucggcuacuacagcgacgacggcaacuauuacugccugcgggcgugcguguccgugcccgucagcgugaucuacgauaaggagaccaagacccacgccacccuguucggguccguggccugcgagcacaucagcuccaccaugagccaguacucccgcagcacccgcuccaugcucaagcggagggacagcacguauggcccgcugcagacccccgucgggugcgugcugggccucgugaacuccagccuauucgucgaggacugcaaguuaccccucgggcaaucgcugugcgcccuccccgacaccccguccacccuuacgccccggagcguucgcuccgugcccggcgagaugcggcuggcuagcaucgcguucaaccacccgauucaggucgaccagcugaacuccagcuauuucaagcucuccaucccgaccaacuucagcuucggcgugacccaagaguacauccagacaacgauccagaagguuacagucgacugcaagcaguacgugugcaacggcuuccaaaagugugagcaacuacugcgagaguacggccaguucugcuccaagaucaaccaggccuuacacggggccaaccugcggcaggaugacucggugcgaaaccuguucgccuccgucaagagcagucagagcucccccaucauccccggguucgggggcgacuuuaaccucacacugcuggaacccgucuccaucuccaccggcagucgguccgcccgcagcgcgaucgaggacuugcuguucgacaaggugacgaucgccgacccggguuauaugcagggcuacgacgacugcaugcagcaggggcccgccagcgcucgggaccugaucugcgcccaguacguggcggguuacaaggugcucccgccccugauggacgugaauauggaagccgccuauaccuccagccugcucggguccauagccggagucggcuggaccgcggggcugagcuccuucgccgcuauccccuucgcccagucgaucuuuuaucgccugaacggcgucgggaucacccagcagguccucuccgagaaccagaaacugaucgcuaacaaguucaaccaggcgcugggcgccaugcagacgggguucacaacaaccaacgaggccuuccggaaagugcaggacgccgucaacaacaacgcccaggcgcucaguaagcuggccuccgaacucucgaacacguucggcgccaucuccgccucaaucggcgacaucauccagcgccuggacguguuggagcaggacgcccagaucgaccggcuaaucaacgggcgccucaccacccucaacgcauucgucgcacagcagcuggugagguccgaaagcgccgcccucuccgcgcagcuggccaaggacaaggugaacgagugcgucaaggcccagagcaagcgcuccggcuucugugggcagggcacccacaucgugagcuucgucgugaacgcccccaacggucuguacuucaugcacgugggguacuaccccucuaaccacaucgaggucgugagcgccuacggccucugugaugcggccaauccuaccaacugcaucgccccggugaaugguuacuucaucaagaccaacaacacgcgggucguggacgaauggagcuacaccggcucuagcuucuacgcccccgagcccaucacgucccugaauaccaaguacguggcgccccaggucaccuaccagaacaucagcaccaaccugccgccgccucuccuauccaacagcaccgguauugacuuccaggaugagcuggacgaguucuucaagaacguguccacgucaauccccaacuucggcucccucacucagaucaacaccacccuacucgaucucacguacgagaugcugucucugcaacaggucgucaaggcccucaacgaguccuacaucgaccugaaggagcugggcaacuacacauauuacaacaaguggcccugguacaucuggcucgguuucauagccggccugguggcccuggcccucugcguguucuucauccuguguugcacgggcugcggcacaaacugcauggggaagcugaagugcaaccgcugcugugauagauacgaggaguacgaccuggagccucacaagguccacguacacuga

SEQ ID NO: 1266 - RNA, 4062 nt, Artificial Sequence; identical to SEQ ID NO: 354
  derived and/or modified CDS sequence (opt11) from MERS-CoV__ALJ54483__S

SEQ ID NO: 1267 - RNA, 4062 nt, Artificial Sequence; identical to SEQ ID NO: 355
  derived and/or modified CDS sequence (opt11) from MERS-CoV__ALJ54486__S

SEQ ID NO: 1268 - RNA, 4062 nt, Artificial Sequence; identical to SEQ ID NO: 356
  derived and/or modified CDS sequence (opt11) from MERS-CoV__ALJ54488__S

SEQ ID NO: 1269 - RNA, 4062 nt, Artificial Sequence; identical to SEQ ID NO: 357
  derived and/or modified CDS sequence (opt11) from MERS-CoV__ALJ54490__S

SEQ ID NO: 1270 - RNA, 4062 nt, Artificial Sequence
  derived and/or modified CDS sequence (opt11) from MERS-CoV__ALJ54495__S
augauccacagcguguuccuucugauguuucuauuaacccccaccgaguccuacguagacguugguccggauagcgugaaguccgccugcauugaggucgacauccagcagacuuucuuugacaagaccuggccccgccccaucgacgugagcaaggccgacgggaucaucuauccccagggccggaccuacuccaacauuaccauuacguaucaaggccucuuuccguaccagggcgaccacggggacauguacguguacagcgcgggccacgccaccggcaccacgccccagaagcuguucgucgccaacuauucucaggacguaaaacaguucgccaauggauucgugguccgcaucggcgccgcggccaacagcaccgggaccgugaucaucuccccgagcaccuccgccaccauccggaaaauauaccccgccuucaugcugggcucguccguggggaacuucagcgacggcaagaugggccgcuucuucaaucacacgcucguccuguuaccggacggguguggaacccugcugcgggcuuucuacugcauccucgagccucgguccgggaaccacugccccgcuggcaacagcuacaccuccuucgcaacguaucacacucccgccaccgacugcagcgacggcaacuacaaucggaacgccucgcucaauagcuucaaggaguacuucaaccuccgcaacugcaccuucauguacaccuacaacaucacggaggacgaaauccuggagugguucgggaucacgcaaaccgcgcagggcgugcaucuguucagcucccgguacguagaccuguacgggggaaacauguuccaguucgccacacugccggucuacgacacgaucaaguacuacagcaucaucccgcacucaauacgcagcauccaauccgaccggaaggccugggccgccuucuacguguauaagcuccagccucugaccuuccugcucgacuucuccguggacggguacauccgccgggcgaucgacugcggcuucaacgaccugucccagcugcauuguagcuacgaguccuucgacgucgagagcggcguguacucuguaagcuccuucgaggccaagccuagcggguccgucguagagcaggccgagggcguagagugcgacuucucaccgcuucuguccgggaccccgccccagguuuauaacuucaagaggcugguauucaccaacugcaacuacaacuuaaccaaacugcugagccucuucuccgucaacgacuucacgugcucucagauuagccccgccgccaucgcauccaacugcuacucaucccugauccuggauuacuucagcuacccgcucucgaugaaguccgaccugagcgugagcuccgccgggccgaucagccaguucaacuauaagcaguccuucagcaacccgaccugccugauccucgccaccgugccccacaaccugaccaccaucaccaagccccugaaguauucguacaucaacaagugcagcaggcuccuguccgacgaccgcacggagguaccccagcugguaaacgccaaccaguacucacccugcguguccaucguccccagcacggugugggaggacggggacuacuaucggaagcagcucagcccguuggagggcggcggguggcuggucgucuccggcagcacgguggccaugaccgagcaacuccagaugggguuuggcaucaccgugcaguacgggaccgacacuaacuccgucugccccaaacuggaguuugcaaacgacaccaagaucgccagccaacugggcaacugcguggaguacucacucuacggcgugagcgggcgcggcgucuuccagaacugcacagccguaggcgugcggcagcagcgcuucguauacgacgccuaccagaaccuggugggcuacuacuccgacgauggcaacuacuauugccugcgggcgugcgugagcgucccgguguccgugaucuacgacaaggagaccaaaacgcacgcuacccuguucggaagcguugccugcgaacacaucucgagcaccaugucccaauacagccgcuccacccgcagcaugcucaagcggagagacuccaccuauggcccauugcagacgcccguagggugcgugcugggacucgucaacagcucucuguucguggaggacuguaaguugccccucgggcagagccugugugcccugcccgauaccccaagcacccucacgccccgguccgugcgcagcguccccggcgagaugcgccuugccuccaucgcguuuaaccacccaauccaaguggaccaacugaacagcuccuacuucaagcucuccaucccgaccaacuucuccuucggcgugacucaagaguacauacagaccacgauccagaaggucaccguggacugcaagcaguacguaugcaacggguuccagaagugugagcagcuccugcgcgaguacggccaauucugcagcaagaucaaucaagcccuccacggggccaaccugcggcaggacgacuccgucagaaaucuguucgccagcgugaaguccagccaguccucucccaucauucccggcuucggaggcgauuucaaccucacccuguuggagcccguuaguaucagcaccgguucccggagcgcccgcuccgcgaucgaggaccuccuguucgacaaggucacgaucgccgacccgggguacaugcaaggcuacgacgacugcaugcagcagggccccgcgagcgcgcgagaucugaucugcgcccaguacguggcgggcuacaaagugcucccgccccugauggacgucaacauggaggccgccuacaccagcucccugcucgggagcaucgccggagugggcuggaccgcgggacuguccagcuucgcagccauccccuucgcccaguccaucuucuaucgccugaacggcguggggaucacacaacagguacucagcgagaaccaaaaacugaucgccaauaaguucaaccaggcccugggggccaugcagacgggguucaccaccaccaacgaggccuuccggaagguccaggacgcagugaacaacaacgcccaggcgcucucuaagcuggccagcgaacuguccaacacguucggcgccaucagcgccuccaucggcgacaucauccagaggcucgacguccuggagcaggacgcccagaucgaccggcuuaucaacgggcgccucaccacccugaacgcguucguggcgcagcagcugguucggagcgaguccgccgcccucagcgcgcaguuagccaaggacaaggucaacgagugcgugaaggcccaguccaagcgcagcggcuucuguggacagggcauccacaucgucuccuucguggugaacgccccgaauggccuguacuucaugcacguuggguacuaccccagcaaccauauugagguggucuccgccuacggccucugcgacgcggccaacccuaccaacuguauagccccggucaacggguacuucaucaagacgaacaacacccggaucguggacgaguggagcuacaccggcagcuccuucuacgcccccgagcccaucaccagccugaacacuaaguacguggcgccccaggucaccuaucagaacaucuccaccaaccugccgccaccccuucuggggaacagcaccggcaucgacuuccaagacgagcuggacgaguucuucaaaaacguguccaccaguauccccaacuuugguucccucacgcagauaaacaccacccugcuggaccucaccuacgagauguugagccugcagcaggucguuaaggcgcucaacgaguccuacauagaccuaaaggaguugggcaacuacacguauuacaacaaguggcccugguacauauggcucggcuucaucgccgggcuuguggcccuggcccucugcguguucuucauucugugcugcaccgggugcgggaccaacugcaugggcaagcugaaaugcaaccgcuguugcgacagauacgaggaguacgaccucgagccucacaagguccacgugcacuga

SEQ ID NO: 1271 - RNA, 4062 nt, Artificial Sequence; identical to SEQ ID NO: 359
  derived and/or modified CDS sequence (opt11) from MERS-CoV__ALJ54496__S

SEQ ID NO: 1272 - RNA, 4062 nt, Artificial Sequence
  derived and/or modified CDS sequence (opt11) from MERS-CoV__ALJ54500__S
augauccacagcguguuccugcucauguuccugcugacacccaccgaguccuacgucgacgugggcccagacagcgugaaguccgccugcaucgaggucgacauccagcagacguucuucgacaagaccuggccccgccccaucgacgugagcaaggccgacgggaucaucuacccccagggccguaccuacuccaacauaaccaucacguaccagggccucuucccguaccagggggaccacggggacauguacguguacagcgcgggccacgccaccggcaccacgccucagaagcuguucgucgccaacuauucccaggacgugaagcaguucgccaacggguucgugguccgcaucggcgccgcggccaacagcaccgggaccgugaucaucucccccagcaccuccgccacuauccggaagaucuaccccgccuucaugcugggcagcuccguggggaacuucagcgacggcaagaugggccgcuucuucaaccacacgcucguccugcugccggacgggugcggcaccuugcugcgggcguucuacugcauccuggagccccgcuccgggaaccacugccccgccggcaacagcuacaccuccuucgccaccuaccacacgcccgccaccgacugcagcgauggcaauuacaaccggaacgccucccucaacagcuucaaggaguacuucaaccugcgcaacugcaccuucauguacaccuacaacaucacggaggacgagauccuggagugguucgggaucacgcagaccgcgcagggcgugcaccuguucagcucccgguacguggaccuguacgggggcaacauguuccaguucgccacccugccggucuacgacacuaucaaauacuacagcaucaucccccacuccauccgcagcauccaguccgaccggaaggccugggccgccuucuacguguacaagcuccagccccugaccuuccugcucgacuucagcguggacggguacauccgucgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagccuccugcuguccgggaccccgccgcaggucuacaacuucaagcgccucguguucaccaacugcaacuacaaccugacgaagcuccucagccuguucuccgucaacgacuucacgugcagucagaucagccccgccgccaucgccuccaacugcuacagcucccugauccucgacuacuucagcuacccccuguccaugaaguccgaccugucugugagcuccgccggcccgaucagccaguucaacuacaaacaguccuucagcaacccgaccugccucauccuggccaccgugccccacaaccugaccaccaucaccaaaccccucaaguacuccuacaucaacaagugcagccggcugcuguccgacgaccgcaccgaggucccccagcucgugaacgccaaccaauacagccccugcguguccaucguccccagcacgguuugggaggacggggauuacuaccggaagcagcucucacccuuagagggcggcggguggcucguagccuccggcagcaccgucgcgaugaccgagcagcugcaaaugggguucggcaucaccgugcaguacgggaccgacacgaacuccgugugcccgaagcuggaguucgccaacgacaccaagaucgccagccagcucggcaacugcgucgaguacuccuuguacggcgugagcgggcgcggcguguuccagaacuguaccgccgucggggugcggcagcagcgcuucguguacgacgcguaccagaaccuggucggcuacuacuccgacgacggcaacuacuacugucugcgggccugcgugagcgugcccgucuccgugaucuacgacaaggagaccaaaacgcacgccacccucuucgggagcguggccugcgagcacaucuccagcaccaugucccaauacagccgcuccacccgcagcaugcugaagcggcgcgacuccacguacggcccccugcagacccccgucgggugcgugcucggccugguuaacaguucccuguucgucgaggacugcaagcucccccuggggcagagccugugcgcccuccccgacacccccagcacucugacgccgcgguccgugcgcagcgugcccggcgagaugcgguuagcguccaucgccuucaaccaccccauccaggucgaccagcucaauagcuccuacuucaagcugagcauccccaccaacuucaguuuuggcgugacccaagaguacauccagaccacgauccagaaggugaccgucgacuguaagcaguacgugugcaacggguuccagaagugcgagcagcugcuccgcgaguacggccaguucugcagcaagaucaaccaggcccugcacggggccaaccugcggcaggacgauuccgugcgcaaccucuucgccagcgucaaguccagccaauccagcccgaucauucccggcuucgggggcgacuucaaccugacgcugcucgagcccguguccaucagcaccggcucccggagcgcgcgguccgccaucgaggaccugcuguucgacaaggugacgaucgccgacccuggguacaugcagggcuacgacgacugcaugcagcagggcccagccagcgcgcgggaccucaucugcgcgcaguacgucgccggcuacaaggugcugccgccccugauggacguuaacauggaggccgccuacaccaguucccuccuggggagcaucgcgggcgucggcuggaccgccgggcuguccagcuucgccgccauccccuucgcucaguccauuuucuaccgacucaacggcgugggaaucacacagcagguccugagcgagaaccagaaacugaucgcgaacaaguucaaccaggcccucggcgccaugcagacgggguucaccacgaccaacgaggccuuccggaaggugcaggacgccgugaacaacaacgcgcaggcccuguccaagcuggccagcgagcucuccaacacguuuggcgccaucagcgccucgaucggcgacaucauccagcgccuggacgugcuggagcaggacgcgcagaucgaccgccucaucaacgggcgccugaccacccugaaugccuucgucgcccagcagcucgugcggagcgaguccgccgcgcugagcgcccagcuggccaaggacaaggugaacgagugcgucaaggcccaguccaagcgcagcgguuucugcgggcagggcacccacaucguguccuucgucgugaacgcccccaacggccucuacuuuaugcacgugggguacuaccccagcaaccacaucgaggucguguccgcguacggccugugcgacgccgccaaccccacgaacugcaucgcccccgugaacggguacuucaucaagaccaacaacacccggaucgucgacgaauggagcuacaccggcagcuccuucuacgccccggagcccaucacuagcuuaaacaccaaguacguggcuccgcagguuaccuaccagaacaucuccaccaaccuacccccgccccuccuggggaacagcaccggcaucgacuuccaggacgagcucgacgaguucuucaagaacgucuccacgagcauccccaacuucggcagccugacccagaucaacaccacccugcucgaccugacguacgaaaugcugucacuccagcaggucgugaaggcccugaacgaguccuacaucgaccugaaggagcucgggaacuacaccuacuacaacaaguggccgugguacaucugguuaggcuucaucgccgggcugguggcccucgcccugugcguguucuucauccugugcugcaccggcugcgggaccaacugcaugggcaaguuaaagugcaaccgcugcugcgaucgcuacgaggaguacgaccuggagccccacaagguccacguacacuga

SEQ ID NO: 1273 - RNA, 4062 nt, Artificial Sequence
  derived and/or modified CDS sequence (opt11) from MERS-CoV__ALJ54501__S
augauccauagcguguuccugcucauguuccugcugacccccaccgagucauacgucgacgugggcccggacagcgugaaauccgccugcaucgaagucgacauccaacagaccuucuucgacaagaccuggccccgccccaucgacgugagcaaggcagacgggaucaucuacccccaaggccggacauacuccaacaucaccaucacguaccagggccucuucccguaucagggggaccacggggacauguacguguacucagcgggccacgcgaccggcaccacgccccaaaagcuguucgucgccaacuacucccaggacgugaagcaguucgccaacggcuucgugguccgcaucggcgccgccgcaaacagcaccgguaccgugaucaucucccccagcaccuccgccaccauccggaagaucuaccccgccuucaugcugggcagcuccguggggaacuucagcgauggcaaaaugggccgcuucuucaaccacacgcucguccugcugccggaugggugcggcacccuccugcgagcguucuacugcauccuggagccccgcuccgggaaccacugccccgcagggaacagcuacaccuccuucgccaccuaccacacgcccgcgaccgacugcagcgacggcaacuauaaccggaacgccagccucaacagcuucaaggaguacuucaaccugcgcaacugcaccuucauguacaccuacaacaucacggaagacgagauccuggagugguucgggaucacccagaccgcgcagggcgugcaccucuucagcucgcgguacguggaccuguacgguggcaacauguuccaauucgccacgcugccgguuuacgacacgaucaaguacuacagcauaaucccccacucgauccgcagcauccaguccgaccggaaggccugggccgccuucuacguguacaagcuccaaccccugaccuuccugcucgacuucagcguggacggguacauccgccgggcgaucgacugcggcuuuaacgaccucucccagcugcacugcagcuacgaauccuucgacgucgagagcggcguguacuccgugucuuccuucgaggccaagcccagcggguccgugguggagcaggccgagggcguggagugcgacuucagcccgcucuuguccgggaccccgccccaggucuacaacuucaagcgccugguuuucaccaacugcaacuauaaccucacgaagcugcugagccucuucuccgucaacgacuucacgugcagccagaucagccccgccgccaucgcguccaacugcuacagcucccugauccuggacuacuucuccuacccgcucuccaugaaguccgaccugagcguaagcuccgccggccccaucagccaguucaacuacaagcaguccuucagcaacccgaccugccugauccucgcgaccgugccccacaacuugacaaccaucaccaagccccugaaguacagcuacauaaacaagugcagccgucuccuguccgacgaccgcaccgaagucccccagcuggugaacgccaaccaguacagccccugcguguccaucguccccagcacgcucugggaggacggggacuacuaccggaagcagcuuagcccccuggagggcggaggguggcucguggccuccggcagcacuguggcuaugacagagcagcugcagaugggguucggcaucaccguccaguacgggaccgacacgaacuccgugugcccaaagcuggaguucgccaacgacaccaagauagccagccagcucggcaacugcguugaauacagccuguauggcgucagcggccgcggcguguuccagaauugcaccgccguggggguccggcagcaacgcuucguuuacgacgcguaccagaaccuggugggcuacuauuccgacgauggcaacuacuacugccugcgggccugcgucagcgugcccguguccgucaucuacgacaaggagaccaagacgcacgcuacccuuuucgggucuguggccugcgagcacaucucaagcaccaugagccaguacagccgcuccacccgcagcaugcucaagagacgcgacuccacguacggcccgcugcagacccccguggguugcguccucggucuggugaauagcucccuguuuguggaggacugcaagcucccccuggggcaaagccugugugcccuccccgacaccccgagcacgcugacgccccgguccguccgcagcgugccaggcgagaugcgccuagcguccaucgccuucaaccaucccauacagguggaccaacucaacagcuccuacuucaagcugagcaucccuaccaacuucuccuucggcgucacccaggaguacauccagaccaccauccagaaggugaccguggacugcaagcaguacgucugcaacggguuccagaagugcgagcagcugcuccgcgaguacggccaguucugcucuaagaucaaccaggcccugcacggggccaaccugcggcaggacgacuccgugcgcaaccucuucgccagcgugaaguccagccaguccagccccaucauccccgguuucgggggcgacuucaaccugacccugcucgagcccgucucgaucagcaccggcucccggagcgcgcgcuccgccaucgaggaccugcuguucgacaaggugacgaucgccgacccgggguacaugcagggcuacgacgacugcaugcagcaagggccggccagcgcccgggaccuaaucugcgcgcaauacguggccggcuacaagguccugccgccccugauggacgugaacauggaggccgcguacaccucaucccuccucgggagcaucgcgggcgugggcuggaccgccgggcuguccagcuucgccgccauacccuucgcccaguccaucuuuuaccgccucaauggggucgggaucacccagcagguccugagcgagaaccagaagcugaucgcgaacaaguucaaccaggcacucggcgccaugcagacuggguucacgaccaccaacgaggccuuucggaaagugcaggacgccgugaacaacaacgcgcaagcccuguccaagcuggccucugagcucuccaacacguucggcgccaucagcgccuccaucggcgacaucauccagcgcuuggaugugcuggaacaggacgcgcagauugaccggcucaucaacgggcgccugaccacccugaacgcauucguggcgcagcagcucguccggucugaguccgccgcgcuaagcgcccagcuggccaaggauaaggucaacgagugcgugaaagcccaguccaagcgaagcggcuucugcggacagggcacccacaucgucuccuuuguggucaacgcccccaacggccucuacuucaugcacgugggguacuaccccagcaaccacaucgaaguggucuccgcguacggccugugcgacgccgccaaccccacgaacugcauagccccugugaacggguacuucaucaagaccaacaacacgcggaucguggacgaguggucuuacaccggcagcuccuucuacgcccccgaacccaucacgagccugaacaccaaguacgucgcgccccaggugaccuaccaaaacaucuccacuaaccucccuccgccccugcuggggaacagcaccggcaucgauuuccaggacgagcucgacgaguucuucaagaacgugucgacgagcauccccaacuucggcucccugacccagaucaauaccaccuugcuggaccugacauacgagaugcugagccugcagcaagucguuaaggcccugaacgaguccuacaucgaccugaaggagcuugggaacuacaccuacuacaacaaguggcccugguacaucuggcugggcuucauagccgggcugguggcccucgcccugugcgucuucuucauacuguguugcaccggcugcgggacuaacugcaugggcaagcucaagugcaaccggugcugcgacagauacgaagaguacgaccuugagccccauaaggugcacgugcacuga

SEQ ID NO: 1274 - RNA, 4062 nt, Artificial Sequence
  derived and/or modified CDS sequence (opt11) from MERS-CoV__ALJ54502__S
augauccacagcguguuccugcucauguuccugcugacccccaccgaguccuacgucgacgugggaccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguuuacagcgcgggccacgccaccggcaccacgccccagaagcuguucgucgccaacuacucccaggacgugaagcaguucgccaauggguuugugguccgcauaggcgccgcggccaacagcaccgggaccgugaucaucuccccgagcaccuccgccaccauccggaagaucuaucccgccuucaugcugggcagcuccguggggaacuucagcgacggcaagaugggccgcuucuucaaccacacgcucguccugcugccggaugggugcggcacccuccugcgggcguucuacugcauccuggagccccgcucagggaaccacugccccgccggcaacagcuacaccuccuucgccacauaccacacacccgccaccgacugcagcgacggcaacuacaaccggaacgccucccucaacagcuucaaggaguacuucaaccuccgcaacugcaccuucauguacaccuacaacaucacggaggacgagauccuggaaugguucgggaucacccagaccgcgcagggcgugcaccucuucagcagccgguacguggaccuguacgggggcaacauguuccaguucgccacccugccggucuacgacacgaucaaguacuacagcaucaucccccacuccauccgcagcauccaguccgaccggaaggccugggccgccuuuuacguguacaagcuccagccccugaccuuccugcucgacuucagcguggacggguacauccgccgagcgaucgauugcggcuucaacgaccugucccaacugcacugcagcuacgaguccuucgacguagagagcggcguguacuccgucagcuccuucgaggcuaagcccagcgggucggucguggagcaggccgagggcguggagugcgauuucagcccguuacuguccgggaccccgccccaggucuacaacuucaagcgccugguguucaccaacugcaacuacaaccucacgaagcugcugagccucuucuccgucaacgauuucacgugcucacagaucagccccgccgccaucgcguccaacugcuacagcagccugauccuggacuauuucagcuacccucucuccaugaaguccgaccugagcgugagcuccgccgggcccaucagccaguucaacuacaagcaguccuucagcaacccgaccugccugauccucgccaccgugccccacaacuuaaccacuaucaccaagccccugaaguacuccuacaucaacaagugcagccggcuccuguccgacgaccgcacugagguuccccagcuggugaacgccaaccaguacagccccugcguguccaucgucccuagcacggugugggaggacggggacuacuaccggaagcaacucagcccgcuggaaggcggcggguggcugguggccuccggcagcaccgucgcgaugaccgagcagcuccagauggguuucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaauuacuacugccugcgggccugcgugagcgugcccgucucagugaucuacgacaaggagacaaagacgcacgccacccuguucgggagcguggccugcgagcacaucuccagcaccaugucccaguacagccgguccacccgcagcaugcucaagcggcgcgacuccacguacggcccgcugcagacccccgucgggugcgugcugggccucgugaacagcucccuguucgucgaggacugcaagcugccacucgggcagagccugugcgcccugcccgacaccccgagcacccucacgccccgguccgugcgcagcgugcccggcgagaugcgccuggcguccaucgccuucaaccaccccauccaggucgaccagcugaacagcuccuacuucaagcucagcaucccgaccaacuucucauucggcgugacccaggaguacauccagaccacgauccagaaggugaccgucgacugcaagcaguacgugugcaacggguuccagaagugcgagcaacugcugcgcgaguacggccaguucugcagcaagaucaaccaggcccuccacggggccaaccugcggcaggacgacucggugcgcaaccuguucgccagcgucaaguccagccaguccagccccaucauccccggcuucgggggagacuucaaccucacccugcucgagcccguguccaucucuaccggcucccggagcgcgcgcuccgccaucgaggaccuccuguucgacaaggugacgaucgccgacccgggguacaugcagggcuacgacgacugcaugcagcaggggcccgccagcguccgggaccugaucugcgcccaguacguggcgggcuacaaggugcucccgccccugauggacgucaacauggaggccgccuacaccagcucccugcucgggagcaucgccggcgucggcuggaccgcggggcuguccagcuucgccgcgauccccuucgcccaguccaucuucuaccgccugaacggcguggggaucacccagcagguccucagcgagaaccagaaacugaucgccaacaaguucaaccaggcgcugggcgcgaugcagacgggguucaccaccaccaacgaggccuuccggaaagugcaggacgccgugaacaacaacgcccaggcgcucuccaagcuggccagcgagcuguccaacacguuuggcgccaucagcgcguccaucggagacaucauccagcgccucgacguccuggagcaggacgcccagaucgaccggcugaucaacgggcgccucaccacccugaacgcguucguggcccagcagcuagugcggagcgaguccgccgcccucagcgcgcagcuggccaaggacaagguaaaugagugcgugaaggcccaguccaagcgcagcggcuuuugcgggcagggcacccacaucgucuccuucguggugaacgcccccaacggccucuacuucaugcacgucggguacuaccccagcaaccacaucgaggugguguccgccuacggccucugcgacgcggccaacccaacuaacugcaucgccccggucaacggguacuucaucaagaccaacaacacucggaucguggacgaguggagcuacaccggcagcuccuucuacgcccccgagcccaucacgagccugaacaccaaguacguggcgccacaggugaccuaccaaaacauauccaccaaccugccgccgccccuccuggggaacagcaccggcaucgacuuccaggacgagcuggacgaguucuucaagaacguguccacgucgauccccaacuucggcucccucacccagaucaacacuaccuuacuggaccuaacguacgagaugcugagccugcagcaggucgugaaagcccucaacgaguccuacaucgaccugaaggagcuggggaacuacacauacuacaacaaguggcccugguauaucuggcucggcuucaucgccggcuugguggcccuggcccucugcguguucuucauccuuugcugcacaggcugcgggaccaacugcaugggcaagcugaaauucaaccgcugcugugaucgcuacgaggaguacgaccucgagccccacaaaguacacgugcacuga

SEQ ID NO: 1275 - RNA, 4062 nt, Artificial Sequence
  derived and/or modified CDS sequence (opt11) from MERS-CoV__ALJ54512__S
augauccauagcguuuuccugcucauguucuugcugacccccaccgaguccuacgucgacgugggcccggacagcgugaagucagccugcaucgaggucgacauccaacagacguucuucgacaagaccuggccccgcccgaucgacguuucgaaggccgacgggaucauuuacccccagggccggaccuacuccaacaucacaaucacguaccagggccucuucccguaccaaggcgaccacggggacauguacguguauagcgcgggccacgccaccggcaccacgccccagaagcuguucgucgccaacuacucccaggacgugaagcaguucgccaauggguucguaguccgcaucggcgccgccgccaacagcaccgggaccgugaucaucucccccagcaccuccgcgaccauccgaaagaucuaccccgccuucaugcuggggucuuccguaggcaacuucuccgacggcaagaugggacgcuucuucaaccacacacucguccugcugccggaugggugcggcacccuccugcgggcguucuacugcauccuggagccccgauccggaaaccacugccccgccggcaacagcuacaccuccuucgccacauaccacacgcccgccaccgacugcagcgacggcaacuacaaccggaacgccucccucaacagcuucaaggaguacuucaaccugcgcaacugcacuuucauguacaccuacaacaucacggaggacgaaauccuggagugguucgggaucacccagaccgcgcagggcgcccaccuauucagcucccgguacguggaccuguacggcggcaacauguuccaguucgccacccugccaguguacgacacgaucaaguacuacagcaucaucccucacucaauccgcagcauccagucggacaggaaggcaugggccgcguucuacgucuacaagcuccagccccugaccuuccugcucgacuucagcguggacgguuacauccgccgggccaucgacugcggcuucaacgaccugucccagcugcacuguagcuacgaguccuucgacguggagagcggcguauacuccgugagcuccuucgaggccaagcccagcggguccguggucgagcaggccgagggcguggagugcgacuucagcccgcuccuguccgggaccccgccacagguuuacaacuucaagcgccuagucuucacgaacugcaacuacaaccucacaaaacugcugagccucuucuccgugaacgacuucacgugcagccagaucagccccgccgcgauagcgucaaauugcuauaguuccuugauccuggauuacuucagcuacccgcucuccaugaaguccgaccugagcguuagcuccgccgggcccaucagccaguuuaauuacaagcaauccuucagcaacccgacgugccugauccuugccaccgugccccacaaucugacuaccaucaccaagccccugaaguacucguacaucaacaaaugcagccggcuccuguccgacgaccgcaccgaggugccccaguuggucaacgccaaccaguacagcccgugcguguccauugugcccagcacggucugggaggacggggauuacuaccggaagcagcucagcccgcuggagggcgguggguggcucguggcauccggaagcaccguggccaugaccgagcagcuccagaugggguucggcaucaccguucaguacgggaccgacacuaacuccgugugccccaagcuggaguucgcuaaugacaccaagaucgcgagccagcugggcaacugcguggaguacucccucuauggcgucagcgggcgcgguguguuccagaacugcaccgcgguggggguccgucaacagcgcuucguguacgacgccuaccagaaucuggugggcuauuacuccgacgacggcaacuacuacugcuugcgggccugugucagcguucccguguccgucaucuacgacaaggagaccaagacgcacgccacuuuguucgggagcguggccugcgagcacaucuccagcaccaugucccaguacagccgcuccacccgcagcaugcugaagcggcgcgacuccacguacgggccgcugcagacacccguggggugcguccucgggcucgugaacagcucccuguucguggaggauugcaaacuuccccucgggcagagccucugcgcguugcccgacaccccgagcacccucacgccccggagcguccgcucugugcccggcgagaugcggcuggcauccaucgccuuuaaccaccccauccagguggaccaacugaacagcuccuacuucaaacucagcaucccgaccaacuucucuuucggcgucacucaggaguacauccagacaacgauccagaaggugaccguggacugcaagcaguacgucugcaacggguuccagaagugcgagcagcugcugcgcgaguacggccaguucugcagcaagaucaaccaggcccuucacggggccaaccugcggcaggacgacuccguacgcaaccuguucgcgagcgugaaguccagccaguccagccccaucauccccggcuucgggggcgacuucaaccucacccugcuagagcccgucuccaucucuaccggcucccggagcgcccgcagcgccaucgaggaccuccuguucgacaaggugaccaucgccgacccgggguauaugcagggcuacgacgacugcaugcagcaagggcccgccagcgcgcgggaccugaucugcgcccaguacguggccggcuauaagguccucccgccccugauggacgugaacauggaggccgcguacaccagcucccugcucgggagcaucgccggcgucggcuggaccgcagggcuguccagcuucgccgccauccccuucgcgcaguccaucuucuaccgccugaacggcgucgggauuacccagcagguccucagcgagaaccagaaacuuaucgccaacaaguucaaccaggcccugggcgccaugcagacgggguucaccaccaccaacgaggccuuccggaaggugcaggacgcagugaacaacaacgcccaggcucucuccaagcuggcuagcgagcuguccaacacguuuggcgccauaagcgcguccaucggcgacaucauccagagacucgacgugcuggagcaggacgcccaaaucgaccggcucaucaacgggcgccucaccacccugaacgccuucguggcccagcaauugguccggagcgaguccgcagcccucagcgcccagcucgccaaggacaaggugaacgagugcgugaaagcccaguccaagaggagcggcuucugcgggcagggcacccacaucgucaguuucguggucaacgcucccaacggccuguacuucaugcacgugggguacuaccccagcaaccacaucgagguggucuccgccuacggccucugcgacgcggccaaccccacgaacugcaucgcaccggugaacggguacuucaucaagaccaacaacacccggaucgucgacgaauggagcuacaccggcagcuccuucuacgcgcccgagcccaucacgagccugaacacaaaauacgucgcgccccaggugaccuaccagaacaucuccaccaaccugccuccgccccuccuggggaacagcaccgggaucgacuuccaggacgagcuggacgaguucuucaagaacguguccacgagcaucccaaacuucggcucccucacccagaucaacaccacccugcuggaccucacguacgagaugcugagccugcagcaggucgugaaggcccugaacgaguccuacaucgaccugaaggagcugggcaacuacaccuacuacaacaaguggcccugguacaucuggcucggcuuuaucgccgggcugguggccuuagcucucugugucuucuucauccugugcugcaccggcuguggaaccaacugcaugggaaaauuaaagugcaaccguugcugcgaccgcuacgaggaguacgaucucgagccccacaaggugcacguucacuaa

SEQ ID NO: 1276 - RNA, 4062 nt, Artificial Sequence; identical to SEQ ID NO: 364
  derived and/or modified CDS sequence (opt11) from MERS-CoV__ALJ54517__S

SEQ ID NO: 1277 - RNA, 4062 nt, Artificial Sequence; identical to SEQ ID NO: 365
  derived and/or modified CDS sequence (opt11) from MERS-CoV__ALJ54518__S

SEQ ID NO: 1278 - RNA, 4062 nt, Artificial Sequence; identical to SEQ ID NO: 366
  derived and/or modified CDS sequence (opt11) from MERS-CoV__ALW82691__S

SEQ ID NO: 1279 - RNA, 4062 nt, Artificial Sequence; identical to SEQ ID NO: 367
  derived and/or modified CDS sequence (opt11) from MERS-CoV__ALW82742__S

SEQ ID NO: 1280 - RNA, 4062 nt, Artificial Sequence; identical to SEQ ID NO: 368
  derived and/or modified CDS sequence (opt11) from MERS-CoV__ALW82753__S

SEQ ID NO: 1281 - RNA, 4062 nt, Artificial Sequence; identical to SEQ ID NO: 369
  derived and/or modified CDS sequence (opt11) from MERS-CoV__ALX27228__S

SEQ ID NO: 1282 - RNA, 4062 nt, Artificial Sequence
  derived and/or modified CDS sequence (opt11) from MERS-CoV__ALX27232__S
augauccacagcguguuccuguugauguuccuguuaacccccaccgaguccuacguugacgugggcccggacagcguaaaguccgccugcaucgaggucgacauccagcagacguuuuucgacaagaccuggccccgucccauugacgugagcaaggccgacggaaucaucuacccccagggccggaccuacuccaacaucaccauaacguaccagggccucuucccguaccagggcgaccacggggacauguacguguacagcgcgggccacgccacaggcacuacgccccagaagcuguucgucgccaacuacucgcaggacgugaagcaguucgccaacggguucgugguccgcaucggcgccgcggccaacagcacgggaaccgugaucaucucccccagcaccuccgccaccauccgaaagaucuaccccgccuucaugcugggcagcuccguggggaacuucagcuacggcaagaugggccgcuucuucaaccacacgcucguccugcugccggacgggugcggcacccuccugcgcgcguucuauugcauccuggaaccccgcuccgggaaccacugccccgcgggcaacagcuacaccuccuucgccaccuaccacacgcccgccaccgacugcucugacgguaacuacaaccggaacgccucccucaacagcuucaaggaguacuuuaaccugcgcaacugcaccuucauguacaccuacaauaucacugaggacgagauucuggaaugguucgggaucacccagaccgcgcagggcgugcaccucuucagcucccgguacguggaccuguaugggggcaacauguuccaguucgccacccugccagucuacgacacuauaaaguacuacagcaucaucccacacagcauccgcagcauccaauccgaccggaaggccugggccgccuucuacguguacaagcuccagccccugaccuuccugcucgacuuuagcguggacggguacauccgccgggcgaucgauugcggcuucaacgaccugucccagcugcacugcagcuacgaguccuucgaugucgagagcgguguguacuccguuagcuccuucgaggccaagcccagcggguccgucguggagcaagccgagggcguggagugcgacuucucuccucuccuguccgggaccccgccccaggucuacaacuucaaacgccugguguucaccaacugcaacuacaaccucacgaagcugcugagccucuuuuccgucaacgacuucacgugcagccagaucagccccgccgcaaucgccuccaacuguuacagcagccugauccucgacuacuucagcuacccccucuccaugaaguccgaccugagcgugagcuccgcggggccaaucagccaguucaacuacaaacaguccuucagcaacccaaccugccuuauccucgcgaccgugccacacaaccugaccaccaucaccaagccacugaaguacuccuacaucaauaagugcagccgguuguugucggacgaccgcaccgaggucccccagcugguaaacgccaaccaguacagccccugcguguccaucgugcccagcacggugugggaggacggggacuacuaucggaagcagcucagcccgcuggagggcggcggcuggcucguggccuccggcagcaccguugcgaugaccgagcagcuccagaugggguucgguaucaccgugcaguacgggaccgacaccaacuccgugugccccaagcuggaguucgccaacgacaccaagaucgccagucagcugggcaauugcgucgaguacucccucuacggggugagcgggcgcggcguguuccagaacugcaccgccgucggggugcggcagcagcgcuucguguacgacgcguaccagaaccuggucggcuacuacuccgacgauggcaacuacuacugccugcgggccugcgugagcgugcccgucuccgucaucuacgacaaggagaccaagacgcacgccacgcuuuucgggagcguggccugcgagcacaucucaucuaccaugucgcaauacagccgcuccacccgcagcaugcucaaacggcgugacuccacguacggcccgcuccagacccccgucgggugcgugcugggccucgugaacagcucccuguucgucgaagauugcaagcugccccucggucagagccugugcgcccugcccgacaccccuagcacccucacgccccgguccguacgcagcgugcccggcgagaugcggcuggccuccaucgccuucaaccacccuauccaggucgaccagcucaacagcuccuacuucaagcucagcaucccgacaaacuucuccuuuggcgugacccaggaguacauccagaccacgauccagaaggugaccgucgacugcaagcaguacgugugcaacggguuccagaagugcgagcagcugcugcgcgaguacggccaguucugcagcaaaaucaaccaggcccugcacggggccaaccuucggcaggacgacuccgugcgcaaccuguucgcuagcgucaaguccucucagagcagccccaucauccccggcuucgggggcgacuucaaccucaccuuacuggaaccuguguccaucagcaccggcucccggagcgcuagauccgccaucgaggaccuccuguucgacaaggugaccaucgcagacccgggguacaugcagggcuaugacgacugcaugcaacaggggcccgcaagcgcccgggaccugaucugcgcgcaguacgucgccggcuauaaagugcucccgccccugauggacgugaacauggaggccgccuacaccagcucccugcucggguccaucgcgggcgucggcuggaccgccgggcuguccagcuuugccgccauccccuucgcgcaguccaucuucuaccgccuaaacggcguggggaucacccagcagguccucagcgagaaccaaaagcugaucgcgaacaaguucaaccaagcccugggcgcuaugcaaaccggguucaccaccaccaacgaggccuuccggaagguacaggacgccgugaacaacaacgcgcaggcacucuccaaguuggccagcgagcuguccaacacguucggagccaucagcgccuccauaggcgacaucauucagcgccucgacgugcuggagcaggacgcgcagaucgaccgauugaucaacgggcgcuugaccacccugaacgccuucgucgcccagcagcuggugcggagcgaguccgccgcgcugagcgcccagcuggccaaggacaaggugaacgagugcgucaaggcccaguccaagcgcagcggcuuuugcgggcagggcacccacaucgugaguuucgucgugaacgcccccaacggccuguacuuuaugcaugugggguacuaccccucgaaccacaucgacguuguauccgcauacggccucugcgacgccgccaaccccacgaacugcaucgccccugugaacggguacuucaucaagaccaacaacacccggaucgucgacgaguggagcuacaccggcagcuccuucuacgcccccgagccuaucacgagccucaacaccaaguacguagcgccccaagugaccuaccagaacaucuccaccaaccugccaccgcccuugcuggggaacagcaccggcaucgacuuccaggacgagcuggacgaguucuucaagaacgucuccacgagcauccccaauuucggcucccucacccagaucaacaccaccuugcuggaccucacguacgagaugcugagccugcagcaggucgugaaggcccucaacgaguccuauaucgacuugaaggagcuggggaacuacaccuauuacaacaaauggcccugguacaucuggcucggcuucauagccgggcugguggcccuggcccucugcguguucuucauccuguguugcaccggcugcgggaccaacugcaugggcaaacuuaagugcaaccgcugcugcgaccguuacgaggaguacgaccucgagccccacaagguucacguccauuga

SEQ ID NO: 1283 - RNA, 4062 nt, Artificial Sequence
  derived and/or modified CDS sequence (opt11) from MERS-CoV__AMQ48993__S
augauccacagcguguuccugcucauguuccugcugacccccaccgaguccuacgucgaugugggcccggacucagugaaguccgccugcaucgaggucgacauccagcagaccuucuucgacaaaaccuggccccgccccaucgacgugagcaaggccgacgggauuaucuacccccagggccggaccuacuccaacauaaccaucacguaccagggccucuucccguaccagggcgaccacggggacauguacguguacagcgcgggccacgccaccggcaccacgccccagaagcuguucgucgccaacuacucccaggacgugaagcaguucgccaacggguucguuguccgcaucggcgccgcggccaacagcaccgggaccgugaucaucucccccucuaccuccgccaccauccggaagaucuaccccgccuucaugcugggaagcaguguugggaacuucagcgauggcaagaugggccgcuucuucaaccacacgcucguccugcugccggacgggugcggcacccuccugcgggcguucuacugcaucuuagagccccgcuccgggaaccacugccccgccggcaacucauacaccuccuuugccaccuaccacacgcccgccaccgacuguagcgacggcaacuauaaccggaacgccucccucaacucuuucaaggaguacuucaaccugcgcaacugcaccuucauguacaccuacaacaucacggaggacgagauccuggagugguucgggaucacccagaccgcgcagggcguucaccucuucagcucccgguacguggaccuguaugggggcaacauguuccaguucgccacccugccggucuacgacacgauaaaguacuacagcaucaucccccacuccauccgcagcauccagucugaccggaaagccugggccgccuucuacguguacaagcuccagccccugaccuuccugcucgacuucagcguggacgguuacauccgccgagcgaucgacugcggcuucaacgaccuaucacaacugcacugcagcuacgagucauucgacgucgagagcggcguguacuccgugaguuccuucgaggccaagcccagcggauccgucguggagcaggccgagggcguggagugcgacuucucgccgcucuuguccgggaccccgccccaggucuacaacuuuaagcgccugguguucaccaacugcaacuacaaccucacgaagcuguugucucucuucuccgucaacgauuucacgugcagccaaaucucucccgcagccaucgcguccaacuguuacagcagccugauccuggacuacuucagcuacccccucuccaugaagucggaccugagcgugagcuccgccgggcccaucagccaguucaacuacaagcagucauucagcaacccgaccugccugauucucgccaccgugccccacaaccugaccaccaucaccaagccccugaaguacuccuacaucaacaagugcagccggcuccucuccgacgaccggaccgaggucccgcagcuggugaacgccaaccaauacagccccugcguguccaucguccccagcacggugugggaggacggggacuacuaccggaagcaacucucaccgcuggagggcggcggguggcugguggccuccggcagcaucgucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcggacgcggcguguuucagaacugcaccgccgucggggugcggcagcagcguuucguguacgacgcguaccagaaccuggucgguuacuacuccgacgacggcaacuacuacugccugcgggccugcgugagcgugcccgucuccgugauauacgacaaggagaccaagacccacgccacgcuguuugggagcguugccugcgagcacaucuccagcaccaugucccaguacagccgcaguacccgcagcaugcucaagcggcgugacucaaccuauggcccgcuccagacgcccguugggugcgugcugggccucgugaacagcucccuguuugucgaggacugcaagcugccccuagggcagagccugugcgcccugccagacaccccgagcacccucacgccccgguccgugcgcagcguacccggcgagaugcggcuggcguccaucgccuucaaccaccccauccaggucgaucagcugaacagcuccuacuucaagcucucuaucccuaccaacuucuccuuuggcgugacccaggaguacauccagaccaccauccagaaggugacggucgacugcaagcaguacgugugcaacggguuccagaagugcgagcagcuacugcgcgaguacggccaguucugcagcaagauuaaccaggcccuccacggagccaaccugcggcaggaugacuccguccgcaaccuguucgccagcgucaaguccagccaauccagccccaucaucccaggcuucggaggcgacuucaaccucacccugcucgagcccguguccaucagcaccggcucccggagcgcgcgcuccgccaucgaggaccuccuguuugacaaggugaccauugccgacccgggguauaugcagggcuacgacgacugcaugcagcaggggcccgccagcgcccgggaccugaucugcgcgcaguacgucgccggcuacaaggugcucccgccccuaauggacgugaacauggaggccgccuacacgagcucgcugcuugggaguaucgcgggcgucggcuggaccgccgggcuguccagcuucgccgccaucccauucgcccagaguaucuuuuaccgccugaacggcguggggaucacccagcagguccucagcgagaaccagaagcugaucgcgaacaaguucaaccaggcccucggcgccaugcaaaccggguucacgaccaccaacgaggccuuccggaaagugcaggacgccgugaacaacaacgcgcaagcgcucuccaagcuggccagcgaacuguccaacaccuuuggcgcaaucagcgccuccauuggcgacaucauccagcgccucgacgugcuggaacaggacgcgcagaucgaccgucugaucaacgggcgccucacaacccugaaugccuucgucgcccagcagcuaguacggagcgaguccgcagcgcucagcgcccagcuggcuaaggacaaggucaacgagugcgucaaggcccaguccaaacgcagcggauucugcgggcagggcacccacaucguguccuucgucgugaacgcccccaacggcuuguacuucaugcacgugggguacuaccccucaaaccacaucgaggucguguccgcguacgggcucugcgacgccgccaaccccaccaacugcaucacgccggugaacggguacuucauuaagaccaacaacacccggaucgucgacgaguggaguuauaccgggucuuccuucuacgcccccgagcccaucacgucucugaacaccaaguacguggcgccccaggugaccuaucagaacaucagcacgaaccugcccccgccccuccugagcaacuccaccggcaucgacuuucaagacgagcuggacgaguucuuuaaaaacgucagcacauccaucccaaacuucggcagccucacccagaucaacaccacccugcuggaccucacguacgagaugcugucccugcagcagguagugaaggcccucaacgagagcuacaucgaccugaaggagcugggaaacuacacguacuacaacaaguggcccugguacaucugguuaggguucaucgccggccugguggccuuagcccugugcguuuucuucauccugugcugcaccgggugcggcaccaacugcauggggaagcugaagugcaaccgaugcugcgaccgcuacgaggaguacgaccucgagccccauaaggugcacguccacuga

SEQ ID NO: 1284 - RNA, 4062 nt, Artificial Sequence
  derived and/or modified CDS sequence (opt11) from MERS-CoV__AMW90844__S
augauccacagcguguuccugcucauguuccugcugacacccaccgaguccuacgucgacgugggcccggacagcgugaaguccgccugcaucgaggucgacauccagcagacguucuucgacaaaaccuggccccgccccaucgacguuagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguugcaaacuacucccaggaugugaagcaguucgccaacggauucgugguccgcaucggcgccgcggccaacucaaccgggaccgugaucaucucccccagcaccuccgccaccauccggaagaucuaccccgccuucaugcugggcagcuccguggggaacuucucugacggcaagaugggccgcuucuucaaccacacgcucguccugcugccggacgggugcggcacccuccuucgggcguucuacugcauccuggagccccgcuccgggaaccacugccccgccggcaacagcuacaccuccuucgccaccuaccacacgcccgccaccgacugcagcgacggcaacuacaaccggaacgccucacucaacagcuucaaggaguacuucaaccugcgcaacugcaccuucauguacaccuacaacaucacggaggaugagauccuggagugguucgggaucacccagaccgcgcagggcgugcaccucuucagcucccgguacguggaucuguacgggggcaacauguuccaguucgccacccugccggucuacgacacgaucaaguacuacagcaucauuccgcacuccauccgcagcauccaauccgaccggaaggccugggccgccuuuuacguguacaagcuccagccccugaccuuccugcucgacuucagcguggacggguacauccgccgcgcgaucgacugcggauucaacgaccugucccagcugcacugcagcuacgaguccuuugacgucgagagcggcguguacuccgugagcuccuucgaggccaagcccagcggguccgucguggagcaggcagagggcguggagugcgacuucagcccgcuccuguccgggaccccgccgcaggucuacaacuucaagcgccugguguucaccaacugcaacuacaaucucacgaagcugcugagccucuucuccgucaacgacuucacgugcagccagaucucucccgccgcgaucgcguccaacugcuacagcucccugauccuggacuacuucagcuaccccuuguccaugaaguccgaccugagcgugagcuccgccgggcccaucucccaguucaacuacaagcaguccuucagcaacccgaccugccugauccucgccaccgugccccacaaccugaccaccaucaccaagccccugaaguacuccuacaucaacaagugcagccggcuccuauccgacgaccgcaccgaggucccccagcugguuaacgccaaccaguacagcccuugcguguccaucguccccagcacggugugggaggacggggacuacuaccggaagcaacucagcccgcuggagggcggcggguggcuuguggccuccggcagcaccgucgcgaugaccgaacagcuccagaugggguuuggcaucaccuuccaguacgggaccgacacgaacuccgugugucccaagcuggaguucgccaacgacaccaagaucgccagccagcugggcaacugcguggaguacucccucuacggcgucagcgggcgcggcguuuuccagaacugcaccgccguggggguccggcagcagcgcuucguguacgacgcguaccagaaccuggugggcuacuauuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgguccaccagaagcaugcucaagcgacgcgacuccacguacggcccgcugcagacccccgugggguguguccugggccucgugaacagcucccuguucguggaggacugcaagcugccccucggccagagccugugcgcccuacccgacaccccgucuacccucacgccccgguccguccgcagcgugcccggcgagaugcggcuggcguccauugccuucaaccaccccauccagguggaccagcugaacagcuccuacuucaagcucagcauaccgaccaacuucuccuucggcguuacccaggaguacauccagaccacgauucagaaggugaccgucgacugcaagcaguaugucugcaacggguuccagaagugcgagcagcugcuacgcgaguacggccaguuuugcagcaagaucaaccaggcccuccacggggccaaucugcggcaggacgacuccgugagaaaccuguucgcuagcgugaaguccagccaguccagccccaucauccccggcuucgggggcgacuucaaccucacccugcuggagcccgucuccaucagcaccggcucccggagcgcgcgcuccgccaucgaggaccuccuguucgacaaggugacgaucgccgacccggguuacaugcagggcuacgacgacugcaugcagcaggggcccgccagcgcccgggaccugaucugcgcgcaauacguggccggcuacaagguccucccgccccugauggacgugaacauggaggccgccuacaccagcucccugcucgggagcaucgcgggcgugggcuggaccgccgggcuguccagcuucgccgccauccccuucgcccaguccaucuucuaccgccugaauggcgucgggaucacccagcagguccucagcgagaaccagaagcugaucgcaaacaaguucaaccaggcccugggcgccaugcagacgggguucaccaccaccaacgaggccuucaggaaggugcaggacgccguaaacaacaacgcgcaggcccucuccaagcuggccagugaguuauccaacacguucggcgccaucagcgcauccaucggugacaucauccagcgccucgaugugcucgagcaggacgcgcagaucgaccggcugaucaacgggcgcuuaaccacccugaacgccuucguggcccagcagcugguccggagcgaguccgccgcgcucagcgcccagcuggccaaggacaaggugaacgaaugcgugaaggcccaguccaagcgcuccggcuucugcgggcagggcacccacauagucuccuucguggucaacgcccccaacggccuguacuucaugcacgugggguacuaucccagcaaccacaucgaaguggucuccgcguacggccucugcgacgccgcuaaccccacgaacugcaucgccccggugaacggguacuucaucaagaccaacaacacccggaucguggacgaguggagcuacaccggcagcuccuucuacgcccccgaacccaucacgagccugaacaccaaguacgucgcgccccagguuaccuaccagaacaucuccaccaaccugccgccgccccuccuggguaacagcaccggcaucgacuuccaggacgagcuggacgaguucuucaagaacguguccacgagcauccccaacuucggcucccucacccagaucaacaccacccugcuggaccugacguacgagaugcugagccugcagcaggucgugaaggcccugaaugaguccuacaucgaccugaaggagcuggggaacuacaccuacuacaacaaguggcccugguacaucuggcucggcuucaucgccgggcugguggcccuggcccucugcgucuucuuuauccuguguugcaccggcugcgggaccaacugcaugggcaaguuaaagugcaaccgcugcugcgaccgcuacgaggaguacgaccucgagccccacaaggugcacgugcacuga

SEQ ID NO: 1285 - RNA, 4062 nt, Artificial Sequence
  derived and/or modified CDS sequence (opt11) from MERS-CoV__AMW90852__S
augauccacagcguguuccugcucauguuccugcugacccccaccgaguccuacgucgaugugggcccggacagcgugaaguccgccugcaucgagguagacauccagcaaacguucuucgacaagaccuggccccgccccauagacgugagcaaagccgacgggaucauauacccccagggccggaccuacuccaacaucacaaucacuuaccagggacucuuuccguaccagggggaccacggcgacauguacguguacagcgcgggccacgccaccgguaccacgccacagaaacuguucgucgccaacuacucgcaggacgugaaacaguucgcuaacggauucgugguccgcaucggcgcugcagcuaacagcaccgggaccgugaucaucucccccucaaccuccgccacuauccggaagaucuaccccgccuucaugcugggcagcuccguggguaacuucagcgacggcaagaugggacgcuucuucaaccacacgcucguccugcugccggacgggugcggcacccuccugcgagcguucuacugcauccuggagccccgcuccgggaaucacugccccgcgggcaacagcuacaccuccuucgccaccuaccacacgcccgccaccgacugcagcgacggcaacuacaaucggaacgccucccucaacagcuucaaagaguacuucaaucugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuaugacacgaucaaguacuacagcauaaucccccacuccauccgcucgauccaguccgaccggaaggccugggcagccuucuacguguacaagcuccagcccuuaaccuuccugcuagacuucagcgucgacggguauauccgccgggcgaucgacugcggcuucaacgaccugucccagcugcauugcagcuacgaguccuucgacgucgagagcggcguguauuccguguccuccuucgaggccaagcccagcggguccgucguggagcaggccgagggcguggagugcgacuucagcccgcuccucuccgggaccccgccccaagucuacaacuucaagagacugguguucaccaacugcaacuacaacuucacgaaacuccugagccuguucuccgucaacgacuucacgugcagccagauuagccccgccgcgaucgcguccaacugcuacagcucccucauccuggacuacuucagcuacccccuguccaugaaguccgaucugagcgugagcuccgccgggcccaucagccaauuuaauuacaagcaguccuucucaaacccgacgugccugauccuggccaccgugccccacaaccucacgaccaucaccaagccccugaaguacuccuacauuaacaagugcagccggcugcucuccgacgaccgcaccgaggucccccagcuggugaacgccaaccaguacagccccugcguguccaucguccccuccacagugugggaggacggggacuacuacaggaagcaacugagcccguuagagggcggcggguggcugguggccuccggcagcaccgucgcgaugaccgagcaacugcagaugggguucggcaucacugugcaguacgggaccgacacgaacuccgugugccccaagcucgaguuugccaacgacaccaagaucgccagccagcugggcaacugcgucgaguacucccuguacggcgucuccgggcgcggcguauuucagaacugcaccgccgucggggugcggcagcaacgcuucguguacgacgcguaccagaaucucgugggcuacuacuccgacgacgguaacuacuacugccugcgggccugcgugagcgugcccgucuccgugaucuaugacaaggagaccaagacgcacgccacgcuguucgggagcgucgccugcgagcacauuuccagcaccaugucccaguauagccgcuccacccgcagcaugcugaagcggcgcgauuccacguacgggccgcuccagacgcccgucgggugcguccuuggccuggugaacucgucccucuucguagaagacugcaagcugccucuggggcagagccucugcgcccuucccgacaccccaagcacccugacgccgcgguccguccgcagcgugcccggcgaaaugcggcuagccuccaucgccuucaaccaccccauccaaguggaccaacugaacagcuccuacuucaagcucuccaucccaaccaauuucuccuucggcgucacccaggaguacauccagaccacgauccaaaaggugaccgucgacugcaagcaguaugugugcaacggguuccagaagugcgagcagcuacugcgcgaguacggccaguucugcagcaagaucaaucaggcccugcacggggccaaccucagacaggacgacuccgugcgcaaccuguucgccagcgucaagucaagccaguccagcccaaucauccccggcuucgggggcgacuucaaccugacgcuccuggagcccguguccaucagcaccggcucccggagcgcgcgcuccgccaucgaggaccuccuguuugacaaggugacgaucgccgacccgggguauaugcagggcuacgaugacugcaugcaacaggggcccgccagcgcccgggaccugaucugcgcgcaguacgucgccggcuacaaggugcugccgccccucauggacgugaacauggaggccgccuacaccucuucacugcuggggagcaucgcgggcgucggcuggaccgccgggcucuccagcuucgccgccauccccuucgcccaguccaucuucuaccgccugaacggcguggggaucacccagcaaguccugucagagaaccagaagcuaaucgcgaacaaguucaaccaggcccugggcgcgaugcagacgggguucacaaccaccaaugaggccuuccggaaggugcaggacgccgugaacaacaacgcgcaggcccuguccaagcucgccagcgagcuguccaacacguucggagccauuagcgccucaaucggcgauaucauccagcgccuggacgugcucgaacaggacgcgcagaucgaccggcugaucaacgggcgccugacaacccucaacgccuucguggcacagcaacuggugcggagcgaauccgccgcgcugagcgcccagcucgcgaaggacaaggugaacgagugcgugaaggcucaguccaagcgcagcggcuucugcggccagggcacccauaucguguccuucgucgugaacgcccccaacggccuguacuucaugcacgugggguacuaccccagcaaccacaucgaggucguguccgcauacggccugugcgacgccgccaaccccacgaacugcaucgccccggugaacggguacuucaucaagaccaacaauacccguaucgucgacgaguggagcuacaccggcagcuccuucuacgcucccgagcccaucacgagccucaacaccaaauacguugcgccccaggucaccuaccagaacaucuccaccaacuugccaccgccccugcucgggaacagcaccggcaucgacuuccaggaugagcuggacgacuucuucaagaacgucuccacgagcauccccaacuucgguucacugacccagaucaacaccacccuccuggaccugacguacgagaugcucagccugcagcaggucgugaaggccuugaaugaguccuacaucgaccucaaggagcuggggaacuacaccuacuacaacaaguggcccugguacaucuggcugggguucaucgccgggcucguggcccuggcccuguguguguucuucauccucuguugcaccggcugcgggacaaacugcaugggcaagcugaagugcaaccgcugcugcgaccgcuacgaggaguacgaccuggagccccacaaggugcacguccacuga

SEQ ID NO: 1286 - RNA, 4062 nt, Artificial Sequence
  derived and/or modified CDS sequence (opt11) from MERS-CoV__AMW90853__S
augauccacagcguguuccuccucauguuccugcugacccccaccgaguccuacgucgacgugggcagcgacuccgugaaguccgccugcaucgagguggacauccagcagacguucuucgacaagaccuggccgcgccccaucgacguguccaaggcagacgggaucaucuacccucagggccggacguacagcaacaucaccaucacguaccaggggcuguuccccuaccagggcgaccacggggacauguacguguacuccgcgggcuacgccaccggcaccaccccgcagaagcuguucgucgccaacuauagccaggacgugaagcaguucgccaacggguuuguuguccgcaucggcgccgcggccaacuccacggggaccgugaucaucagccccuccaccagcgccaccaucagaaagaucuaccccgccuucaugcugggcuccagcguggggaacuucuccgacggcaagaugggccgcuucuucaaccacacgcucguccugcugcccgacgggugcggcacucuccugcgggcuuucuacugcauccuggagccgcgcagcgggaaccacugccccgccggcaacuccuacaccagcuucgccaccuaccacacgcccgccaccgacugcuccgacggcaacuacaaccggaacgccagccucaacagcuucaaggaauacuucaaccugcgcaacugcaccuucauguacaccuacaacaucacggaggacgagauccuggagugguucggaaucacccagaccgcgcagggcguucaccucuucuccagccgguacguggaccuguacggcggcaacauguuccaguucgccacccugcccgucuacgacacgaucaaguacuacuccaucaucccgcacagcauccgcucaauccagagcgaccggaaggccugggccgccuucuacgucuacaaacuccagccccugaccuuccugcucgacuucuccguggacggguacauccgccgugcgaucgacugcggcuucaacgaccugagccagcugcacugcuccuacgagagcuuugacgucgaauccggcguguacagcguguccagcuucgaggccaagcccuccgggagcgucguggagcaggccgagggcguagagugcgacuucagcccccuccugagcgggaccccuccccaggucuacaacuucaagcgccugguguucaccaacugcaacuacaacuucacaaagcuccugucccuguucagcgucaacgacuucacgugcagccagaucucccccgccgccaucgcuagcaacugcuacuccucucucauccuggacuauuucuccuacccccugagcaugaagucagaccucagcguguccagugccggcccgaucucccaguucaacuacaagcagagcuucuccaacccgaccugccugauucuggccaccgugccccacaaccuuaccaccaucaccaagccccugaaguacagcuacauaaacaagugcucccggcugcucagcgacgaccgcaccgaggucccccaacuggugaacgccaaccaguacucccccugcgugagcaucguccccagcacggugugggaggacggggacuacuaccggaagcagcugagcccacucgagggcggcggguggcugguagccuccggcuccaccgucgcgaugaccgagcagcugcagaugggguucggcaucaccgugcaguacgggaccgacacuaacagcguaugcccgaagcucgaguucgccaacgacaccaagaucgccucccagcugggcaacugcgucgaguacagccuguacggcguguccgggcgcggcguguuccagaacugcaccgccgucggggugcggcagcagcgcuucguguacgaugcguaccagaacuuggucggcuacuacagcgacgacggcaacuacuacugccugcgggccugcguguccgugcccgucagcgugaucuacgacaaggagaccaagacgcacgccacccuguucggguccguggccugcgagcauaucucuucaaccaugagccaguacucccguucgacccgcuccaugcugaagcggcgcgacagcacguacggcccccuccagaccccggucgggugcgugcugggccuggugaacuccucccucuucgucgaggacugcaagcugccacuggggcaaagccucugcgcccugcccgauacccccuccacccugacgccgcggagcgugcgcuccgugcccggcgagaugcggcucgcgucuaucgccuucaaccaccccauccaggucgaccagcugaacuccagcuacuucaagcuguccauccccaccaacuucucuuucggcgugacccaggaguauauucagaccacaauccagaaggugaccgucgacugcaagcaguacgugugcaauggguuccagaagugcgagcagcuccugcgcgaguacggccaguucugcucuaagaucaaccaggcccugcacggggccaaccuccggcaggacgacagcgugcgcaaccuguucgccuccgucaagagcucccagagcuccccgaucauccccggcuucgggggcgacuucaaccuaacccuccuggaacccgugagcaucuccaccggcagccgguccgcgcgcagcgccaucgaggaccuccucuucgacaaggugacgaucgccgaccccggguauaugcagggcuacgacgacugcaugcagcaggggccggccagcgcccgggaccugaucugcgcgcaguacgucgccggcuacaaggugcugccgccccucauggacgugaacauggaggccgccuacaccuccucccugcugggguccaucgcgggcgucggcuggaccgccggguuaagcuccuucgccgccauccccuucgcccagagcauauucuaccgccugaacggcguggggaucacccaacagguccuguccgagaaccagaagcucaucgcgaacaaguucaaccaggcccugggcgccaugcagacgggguucaccaccaccaacgaggccuuccggaaggugcaggacgccgugaacaacaacgcgcaggcccugagcaagcucgccuccgagcugagcaacacguucggcgccaucuccgccagcaucggcgacaucauucagcgccucgacgugcucgagcaggacgcgcagaucgaccggcucaucaacggucgccugaccacccucaacgccuucgucgcccagcagcuggugcgguccgagagcgccgcgcuguccgcccagcucgccaaggacaaagugaacgagugcgucaaagcccagagcaagcgcuccggcuucugcgggcagggcacccacaucgugagcuucgucgugaacgcccccaacggccuguacuucaugcacgugggguacuaccccuccaaccacaucgaagucgugagcgcguauggccugugcgacgcugccaaccccacgaacugcaucgcccccgugaacggguacuucaucaagaccaacaacacacggaucgucgacgaguggagcuacaccggcuccagcuucuacgcacccgagcccaucacgucccucaacaccaaguacguggcgccccaggugaccuaucagaacaucagcaccaaccugccgccgccccugcucgggaacuccaccggcaucgacuuccaggaugagcuggacgaguucuucaagaacgucagcacguccauccccaacuucggcagccugacccagaucaacaccacauugcuggaccugacguacgagaugcucucccugcagcaggucgugaaggcucugaacgagagcuacaucgaccucaaggagcuggggaacuacaccuacuacaacaaguggccgugguacaucuggcugggcuucaucgccgggcucguggcccuggcccugugcguguucuucauccucugcugcaccggcugcgggaccaacugcaugggcaagcucaagugcaaccgcugcugcgaccgcuacgaggaguaugaccuggagccccacaaggugcacguccacuga

SEQ ID NO: 1287 - RNA, 4062 nt, Artificial Sequence; identical to SEQ ID NO: 375
  derived and/or modified CDS sequence (opt11) from MERS-CoV__ANC28656__S

SEQ ID NO: 1288 - RNA, 4062 nt, Artificial Sequence; identical to SEQ ID NO: 376
  derived and/or modified CDS sequence (opt11) from MERS-CoV__ANC28678__S

SEQ ID NO: 1289 - RNA, 4059 nt, Artificial Sequence; identical to SEQ ID NO: 377
  derived and/or modified CDS sequence (opt11) from MERS-CoV__AHL18090__S

SEQ ID NO: 1290 - RNA, 4062 nt, Artificial Sequence
  derived and/or modified CDS sequence (opt11) from MERS-CoV__AHX00731__S
augauucacucaguguuccugcucauguuccugcuaacucccacggaguccuacgucgacgucggcccggacagcgugaaguccgccugcaucgaggucgacauccagcaaacguucuucgacaagacauggcccaggcccaucgacgugagcaaggccgacggcaucaucuacccccagggccggaccuacuccaacaucacuauuacguaccagggcuuauucccguaccagggugaccacggggacauguacguguacagcgcgggccacgccaccggcaccacgccccagaagcuguucgucgccaacuacucccaggacgugaagcaguucgccaacggguucgugguccgcaucggcgccgcugccaacagcacuggaaccguaaucaucucccccucgaccuccgcuaccauccggaagaucuaccccgccuucaugcucggcagcuccgucggcaacuucagcgacggcaagaugggccgcuucuuuaaccacacgcucgucuugcugccugacgggugcgggacgcucuugcgggcguucuacugcauccuggagccccgcuccgggaaccacugcccagccggcaacagcuacacuuccuucgccaccuaccacacccccgccaccgacugcagcgacggcaacuacaaucggaacgcgucccucaacagcuucaaagaauacuucaaccugcgcaauugcaccuucauguacaccuacaacaucacagaggacgagauccuggaaugguucgguaucacccagaccgcgcagggagugcaccucuucagcucccgguacguggaccuguacgggggcaacauguuccaauucgccacccugccggucuacgacacgaucaaguauuacagcauaaucccccacuccauccgcagcauccaauccgaucggaaggccugggccgccuucuacguguacaaacuccagccccugaccuuccugcucgacuucagcguggacggguacauccgucgggcgaucgacugcggcuucaacgaccugagccagcuacacugcagcuacgaauccuucgacgucgagagcggaguguacuccgugucuuccuucgaggccaagccgagcggguccgucguggagcaggcugagggcguggaaugcgacuucagcccgcuauuguccgggacgccgccccaaguauacaacuucaagcgacucgucuucacuaacugcaacuacaaccucacgaagcugcugagccuauucuccgucaacgacuucacgugcucccagaucagucccgccgccaucgcguccaacugcuacagcucccugauacuggacuacuucagcuacccccucuccaugaaguccgacuuagggguuagcagcgccgggcccaucucccaguucaacuacaaacagagcuucuccaacccgaccugccugauacucgccacuguaccacacaacuugaccacaauuaccaagccccugaaguacagcuacaucaacaagugcucccggcuccugagcgacgaucgcaccgaagucccccaacuggugaaugccaaccaguauucccccugcgugaguaucgucccguccacggugugggaggauggcgacuacuaccgaaagcagcucagcccgcuggagggcgggggcuggcugguggccagcggguccacggucgcgaugaccgagcagcuccagaugggcuucgggaucacugugcaauacggcaccgacacgaacagcgugugccccaagcuggaguucgcgaacgacaccaagauagcgucccagcuggguaacugcgucgaguacagccucuacggcguguccggccgcgggguguuccagaacugcaccgccgugggcgugcgccagcagcgcuucguguacgacgcguaucagaaccuggucggcuacuacagcgacgacgggaacuacuacugccugcgggccugcgugucagugcccgucagcgugauauacgacaaggagaccaagacgcacgccacccuguucggcuccguggccugcgagcacaucagcuccaccaugucucaguacucccgcagcacccgcuccaugcuaaaacgacgcgacagcacauacgggccacugcagacccccgucggcugcgugcuggggcucgugaacuccagccucuuugucgaggacuguaagcugccccucggccagagccugugcgcgcugcccgauacgccgagcaccuugacgccccggagcgugcgcagcgugcccggagagaugcggcuggcgagcaucgccuucaaccaccccauccaagucgaccaguucaacucgagcuacuucaagcugucaaucccgaccaacuucucguuugggguuacccaagaauacauccagaccacgauccagaaagugaccgucgacugcaagcaguacauauguaacggcuuccagaagugcgagcaacuccuccgcgaguacgggcaguucugcaguaagaucaaccaggcccugcacggcgccaaccuccggcaggacgacagcgugcgcaaccuguucgccagugucaagagcucgcagagcucccccaucauccccggauucggcggcgacuucaaccugacucuccuggaacccgugagcaucuccacggggucccgguccgcgcgcagcgccaucgaggacuugcuguucgacaaggugacaauagccgacccaggcuacaugcagggauacgaugauugcaugcagcagggcccugccuccgccagggaccucaucugcgcgcaguauguagccggauacaagguccugccaccccugauggacgugaacauggaggcagccuacaccagcagccugcugggcuccaucgcgggcgugggguggaccgcgggccucucguccuucgccgccauccccuucgcccagagcaucuucuaccgccugaacggggucggcaucacccagcagguccuguccgagaaccagaagcucaucgcgaacaaguucaaccaggcccugggggccaugcagacgggcuucaccacuacaaacgaggcguuccggaagguccaggacgccgugaacaacaaugcgcaggccuuaagcaagcucgccucagagcugagcaauacguucggcgccaucuccgccagcaucggagacauuauccagagguuagacgugcucgagcaggacgcgcaaaucgaccggcuaaucaacggccggcugaccacgcucaacgccuucguagcucagcagcuaguccgguccgagagcgccgcacuguccgcccagcucgccaaggacaaggugaaugaaugcgugaaggcccagagcaagcgcuccggguucugcggccagggcacccacaucgucucuuucguggugaacgcccccaacgggcuguacuucaugcaugugggauauuaccccuccaaccauaucgagguggucagcgcguacgggcugugcgacgccgccaaccccacuaacuguaucgccccggugaacggguacuucaucaagaccaacaacaccaggaucguggacgagugguccuacaccgggagcagcuuuuauagucccgagccaaucacgucccucaacaccaaguacguugcgccccaggugaccuaccagaacaucuccacaaaccugccgccgccccugcucggcaacucaaccggcauugauuuucaagacgagcuggacgaguucuuuaagaacguguccacaucgauccccaacuuugggucucugacccagauaaauaccacccuccuggaccugacguacgagaugcuuagccugcagcaggucguuaaggcacuaaacgaguccuacaucgaccucaaggaacugggcaauuacaccuacuacaacaaguggcccugguacaucuggcugggguucaucgccggccucguggcacuggcccugugcguguucuucauccucugcugcaccggguguggcacuaacugcaugggcaagcugaagugcaaccgcugcugcgaccgguacgaggaguacgaccuggaaccccauaaggugcacgugcacuga

SEQ ID NO: 1291 - RNA, 4062 nt, Artificial Sequence; identical to SEQ ID NO: 379
  derived and/or modified CDS sequence (opt11) from MERS-CoV__AHX71946__S

SEQ ID NO: 1292 - RNA, 4062 nt, Artificial Sequence; identical to SEQ ID NO: 380
  derived and/or modified CDS sequence (opt11) from MERS-CoV__AHY22545__S

SEQ ID NO: 1293 - RNA, 4062 nt, Artificial Sequence; identical to SEQ ID NO: 381
  derived and/or modified CDS sequence (opt11) from MERS-CoV__AHY22555__S

SEQ ID NO: 1294 - RNA, 4062 nt, Artificial Sequence; identical to SEQ ID NO: 382
  derived and/or modified CDS sequence (opt11) from MERS-CoV__AHY22565__S

SEQ ID NO: 1295 - RNA, 4062 nt, Artificial Sequence; identical to SEQ ID NO: 383
  derived and/or modified CDS sequence (opt11) from MERS-CoV__AJG44069__S

SEQ ID NO: 1296 - RNA, 4062 nt, Artificial Sequence
  derived and/or modified CDS sequence (opt11) from MERS-CoV__AJG44080__S
augauccacagcguguuccugcucauguuccuacugacccccaccgaguccuacgucgacgugggcccggacagcgucaaauccgcaugcaucgaggucgauauccagcaaacguucuucgacaaaaccuggcccagacccaucgacgucagcaaggccgacgggaucaucuacccccaaggucggaccuacuccaacaucacgaucacguaccagggucucuucccguaccagggcgaccacggggacauguacguguacagugcgggccacgccaccggcaccacgccccagaagcuguucguugccaacuacucccaggacguaaagcaguucgccaacgguuucgugguccgcauaggcgccgcggccaacagcaccgggaccguuaucaucucccccagcacuucagcuaccauccggaaaauuuaucccgccuucaugcugggcucaucgguggggaauuucagcgacggcaagaugggccgcuucuucaaccacacgcucguccugcuucccgacgggugcggcacccuccuacgggcauucuacugcauccuggagccccgcuccgggaaccacugccccgccggcaacucguauacauccuucgccaccuaccacacgccagccaccgacugcagcgacggcaauuacaaccggaacgcaucgcucaacuccuucaaggaauacuucaaccugcgcaacugcacguucauguacacauacaacaucacggaggacgagauuuuagagugguucgggauuacccagaccgcgcagggcguccaccuguuuucaucccgguacguggaccuguacgggggcaacauguuccaauucgccaccuuaccugucuacgacaccauaaaguacuacagcaucaucccacauuccauccgcucaauaaaguccgaucggaaagccugggccgccuucuacgucuacaaguugcagccccugaccuuucuguuggacuucagcguggacggguacaucaggcgggcaaucgacugcggcuuuaacgaccugucccagcugcacugcagcuacgaguccuucgacgucgagagcgggguauauuccgugagcuccuuugaggccaagcccagcggauccguuguggagcaggccgaggguguugagugcgacuucagcccacuccugagugggaccccgccccaggucuacaacuucaagcgcuugguguucacgaauugcaacuacaaccucacgaaacugcuaagccucuucucugucaacgauuuuacgugcagccagauuagccccgccgccauugcguccaauugcuacagcucccucauccuagacuauuucagcuacccccucuccaugaagucggaccugagcgugagcucagcagggcccaucagccaguucaacuacaaacaguccuucagcaacccgacgugccugauucucgccaccgugccgcacaaccugacuacgaucacuaagccccugaaguacuccuacaucaacaagugcagccggcugcucucugacgaccgcacugaggucccccagcuggugaacgcgaaccaauacucaccgugcguguccauagugcccagcacggugugggaggacggggacuacuauaggaagcagcucagcccgcuggagggcggcggguggcugguggccuccggcaguacggucgccaugaccgagcagcuccagaugggguucggcaucaccguccaguacgggacugacacgaacuccgugugccccaaguuagaguucgccaacgauacaaagauugcuagccaacucggcaacugcgucgaguacucccucuacggcgugagcgggcguggcguguuccagaacugcaccgccgucgggguacgucagcagcgguucguguacgacgcuuaccagaaccuugucggcuacuacucagacgacggcaacuacuacugcuugcgggcuugcgugagcgugcccgucucggugaucuaugauaaggagaccaagacacaugccacccuguucgggucgguggccugcgagcauaucuccucgaccaugucgcaguacagccgcuccacccgcagcaugcucaagcggcgugacuccacguacggaccgcugcagacccccgucggguguguguugggccucgugaacagcucccuguucgucgaagacugcaagcugccccucgggcaaucgcugugcgcccugcccgacaccccgucuccccucacuccccguuccgugcgcagcgugcccggcgagaugaggcuggcguccauagccuucaaccacccgauccaggucgaccagcugaacucguccuacuuuaagcucagcaucccuaccaacuucuccuucggcgugacccaagaguacauccagacaaccauccagaaggugacggucgauugcaaacaguacaucugcaacggguuccagaagugcgagcaacugcuucgcgaguacggucaauucugcucgaagaucaaccaggcccugcauggggccaaccugcggcaggaugacuccgugcgcaaccuguucgccuccgugaaguccagccaguccucccccaucauccccggcuuuggcggcgacuucaaccuaacccugcucgagccggucuccaucucuaccggaucacggagcgcccgcuccgccauagaggaccuccuguuugacaaaguuaccauugcagaccccggguacaugcagggcuacgacgacuguaugcagcagggccccgccagugcccgggaccugaucugcgcgcaguacguggcaggcuauaaagucuugcccccgcucauggaugugaacauggaggcggccuacacgagcucccugcucgggaguaucgcgggcgucggcuggaccgccgggcuguccuccuucgcagccaucccuuucgcucaguccauuuucuaccgccuaaauggagucgggaucacacaacagguccucagcgagaaccagaaguugauagcgaacaaauucaaccaagcucuuggagccaugcagaccggauucacgacaaccaacgaggcguuccggaaagugcaggacgccgugaacaacaacgcgcaggcucucuccaaacuggcuagcgagcuguccaacaccuucggcgccaucucagccuccaucggcgacauaauucagcgcuuagaugugcuggagcaggacgcgcaaaucgaccgguugaucaacggucgccuaacaacccuuaacgccuucguggcucaacagcugguccggucagaauccgccgcgcucagcgcccagcuugccaaggacaaggucaacgagugcguuaaagcccaauccaagcgcuccggauucugcggccaggggacgcauaucguauccuucgugguuaacgcccccaauggccuguacuucaugcacgucggguacuaccccagcaaccauaucgaagucgucuccgcguacggccugugugacgcggcuaacccgaccaauugcaucgcgcccguuaacggguacuucauaaagacaaacaacacccggaucguggacgaauggagcuacaccggcagcuccuuuuauagcccagagcccaucaccuccuugaacacgaaguacgucgcgccccaggucaccuaucaaaacaucagcacuaaucugccuccaccccuccugggcaacuccaccggcauagacuuccaggacgaacuggacgaguucuucaaaaacgugagcacguccauccccaacuucggcagucucacacagaucaauacuacacugcuggaccucaccuacgagaugcucucccugcaacaaguuguaaaggcgcucaacgagucguacaucgaccuuaaagagcuggggaacuacacguacuacaacaaguggcccugguacaucuggcucggcuucaucgccggucuagucgcgcuugcccucugcgucuucuucauacugugcugcaccggcugugggaccaacugcaugggcaagcugaagugcaaccgcugcugugaccgcuacgaggaguacgaccucgagccccacaaggugcacgugcacuaa

SEQ ID NO: 1297 - RNA, 4062 nt, Artificial Sequence
  derived and/or modified CDS sequence (opt11) from MERS-CoV__AJG44102__S
augauccacagcguguuccugcucauguuccugcugaccccaacggaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccuuuucccguaccagggcgaccacggggacauguacguguacucagcgggccacgccaccggcaccacgccacagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguuggaaacuucagcgacggcaagaugggccgcuucuucaaccacacuuugguccugcugccggacgguugcggcacccuccugcgggcguucuacugcauacucgagccccgcuccgggaaccacugccccgccggcaacagcuacaccuccuucgccacguaccacacgcccgccaccgacugcagcgacggaaacuacaaccggaacgccucccucaacagcuucaaggaguacuucaaccugcgcaacugcaccuucauguacaccuacaacaucacggaggacgagauccuggagugguucggaaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaauccgaccggaaggccugggccgccuucuacguguacaagcuccagccccugaccuuccugcucgacuucagcguggacggguacauccgccgggcgauagacugcggcuucaacgaccugucccagcugcacugcagcuacgaguccuucgacgucgagagcggcguguacuccgugagcuccuucgaggccaagccaucaggguccguuguggagcaggccgagggcguggagugcgacuucagcccgcuccuguccgggaccccgccccaggucuacaacuucaagcgccugguguucaccaacugcaacuacaaccucacgaaacuucugagccucuucuccgucaacgacuucacgugcagccagaucagccccgcagccaucgcguccaacugcuacagcucccugauccuggacuacuucucuuacccccucuccaugaaguccgaccuguccgugagcuccgccgggcccaucagccaguucaacuacaagcaguccuucagcaacccgaccugccugauccucgccaccgugucccacaaccugaccaccaucaccaagccacugaaguacagcuacaucaacaagugcucccggcuccugagcgacgaccgcaccgaggucccccagcuggugaacgccaaccaauacucccccugcgugucaaucguccccagcacggugugggaggacggggacuacuaccggaagcagcucagcccccuagagggcggcggguggcugguggccuccggcuccaccgucgcgaugaccgagcagcuccagaugggguucggaaucaccgugcaguacgggaccgauacgaacagcgugugcccgaagcuggaguucgccaacgacaccaagaucgccucccaacugggcaacugcgucgaguacagucucuacggcguguccgggcgcggcguguuccagaacugcaccgccgucgggguucggcagcagcgcuucguguacgacgcguaccagaaccuggucggcuacuacagcgacgacggcaacuacuacugccugcgggccugcguguccguccccgucagcgugaucuacgacaaggagaccaagacgcacgccacccuguucggguccguggccugcgagcacaucagcuccaccaucagccaguacucccgcagcacccguuccaugcucaagcggcgcgacagcacguacggcccccugcagaccccggucgggugcgugcugggccucgugaacuccagccuguucguugaggacugcaagcugccccucgggcaaagccugugcgcccugcccgacacucccuccacccucacgccgcggagcgugcguuccgugcccggcgaaaugcggcuggcguccaucgccuucaaccaccccauccaggucgaccagcugaacuccagcuacuucaagcucuccauccccaccaacuucagcuucggcgucacccaggaguacauccagaccacgauucagaaggugaccgucgauugcaagcaauacgugugcaacggguuccagaagugcgagcagcugcugcgugaguauggccaguucugcagcaagaucaaccaggcccuccacggggccaaccugcgacaggacgacagcgugcgaaaccuguucgccuccguaaagagcucgcagagcuccccgaucauccccggcuucgggggcgacuucaaccucacccugcuggagcccgugagcaucagcaccggcagccgguccgcgcgcagcgccaucgaggaccuccuguucgacaaggugacgaucgccgaucccggguacaugcagggcuacgacgacugcaugcagcaggguccggccagcgcccgggaucuaaucugcgcgcaguacgucgccggcuacaaggugcucccgccccugauggacgugaacauggaggccgccuacaccuccucucugcucggauccaucgcgggcgugggcuggaccgccgggcugagcuccuucgccgccauccccuucgcccagagcauauucuaccgccuaaacggcguggggaucacccagcagguccucucggagaaccagaagcugaucgcgaacaaguucaaccaggcccugggcgcuaugcagacgggguucaccaccaccaacgaggccuuccgcaaggugcaggacgccgugaacaauaacgcgcaggcccucagcaagcuggccuccgagcugagcaacacguucggcgccauauccgccagcaucggcgacaucauucagcgccucgacgugcuggagcaggacgcgcagaucgaccggcugauaaacgggcgccucaccacccugaacgccuucgucgcccagcagcuggugcgguccgagucugcggcgcucuccgcccagcuggccaaggacaaggugaacgagugcgucaaggcccagagcaagcgcuccggcuucugcgggcagggcacccacaucgugagcuuuguagucaacgcccccaacggccuguacuucaugcacguuggguacuaccccuccaaccacaucgaggucgugagcgcguacggccucugcgacgccgccaaccccacgaacugcaucgcccccgugaacggguacuucaucaagaccaacaauacccggaucgucgacgaguggagcuacaccggcuccagcuucuauuccccggagccuaucacgagccugaacacaaaguacguggcgccccaggugaccuaccagaacaucuccaccaaccugcccccgccccuccuggggaacagcaccggcaucgacuuccaggacgagcuggacgaguucuucaagaacguguccacgagcauucccaacuucggcucuuuaacccagaucaacaccacccugcuggaccucacguaugaaaugcugagccugcagcaggucgugaaggcgcucaacgaguccuacaucgaccugaaggagcuggggaacuacaccuacuacaacaaguggccgugguacaucuggcucggcuucaucgccgggcugguggcccuggcccucugcguguucuucauccugugcugcacaggcugcgguaccaacugcaugggcaagcugaagugcaaccgaugcugcgaccgcuacgaggaguacgacuuggagccccacaaggugcacguccacuga

SEQ ID NO: 1298 - RNA, 4062 nt, Artificial Sequence; identical to SEQ ID NO: 386
  derived and/or modified CDS sequence (opt11) from MERS-CoV__AJG44124__S

SEQ ID NO: 1299 - RNA, 4062 nt, Artificial Sequence; identical to SEQ ID NO: 387
  derived and/or modified CDS sequence (opt11) from MERS-CoV__ALL26396__S

SEQ ID NO: 1300 - RNA, 4062 nt, Artificial Sequence; identical to SEQ ID NO: 388
  derived and/or modified CDS sequence (opt11) from MERS-CoV__ALS20350__S

SEQ ID NO: 1301 - RNA, 4062 nt, Artificial Sequence
  derived and/or modified CDS sequence (opt11) from MERS-CoV__ALT66880__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguaucuaaggccgacgggaucaucuacccccagggccggaccuacuccaacaucaccaucacguaccagggccucuucccguaccagggcgaccauggggacauguacguguacagcgcgggccacgccaccggcaccacgccccagaagcuguucgucgcgaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccucuuacgggcguucuacugcauccuagagccucgcuccgggaaccacugccccgccggcaacagcuacaccuccuucgccaccuaccacacgcccgccaccgacugcucugacggcaacuacaaccggaacgccucccucaacagcuucaaggaauacuucaacuugcgcaacugcaccuucauguacaccuacaacaucacggaggacgagauccuggaaugguucgggaucacccagaccgcgcagggcgugcaccucuucucuucccgguacguggaccuauacgguggcaacauguuccaauucgccacccugccggucuacgacacgaucaaguacuacagcaucaucccccacuccauccgcagcauccaguccgaccggaaggccugggccgcauucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccucgggguccguaguggagcaggccgagggcguggagugcgacuucucaccgcuccuguccgggaccccgccccaggucuacaacuuuaagcgccugguguucaccaacugcaacuacaaccucacgaagcugcugagccucuuuuccgucaacgacuucacaugcucucagaucucacccgccgccaucgcguccaacugcuacagcucccucauccuggacuacuucagcuacccccucuccaugaaguccgaccugagcgugucauccgccgggcccaucagccaguucaacuacaagcaguccuucagcaacccgaccugccugauccucgccaccgugccccacaaccugacuaccaucacuaagccccugaaguacuccuacaucaacaagugcagccggcuccuguccgacgaccgcaccgaggucccccagcugguuaacgccaaccaguacagccccugcguguccaucguccccagcacggugugggaggacggggacuacuaccggaagcagcucagcccgcuggagggcggcggguggcugguggccuccggcagcaccgucgcuaugaccgagcagcuccagaugggguucggcaucaccgugcaguacgggaccgacaccaacuccgugugccccaagcuggaguucgccaacgacaccaagaucgccagccagcugggcaacugcgucgaguacucccucuacggcgugagcgggcgcggcguguuccagaacugcaccgccguugggguacggcagcagcgcuucguguacgacgcguaccagaaccuggucggcuacuacucugacgacggcaacuacuacugccugcgggccugcgugagcgugcccgucucggugaucuacgacaaggagaccaagacgcacgccacccuguucgggagcguggccugcgagcacaucuccagcaccaugucacaguacucucgcuccacccgcagcaugcucaagcggcgcgauuccaccuacggcccguugcagacccccgucgggugcgugcugggccucgucaacagcucccuguucgucgaggacugcaagcugccccucgggcagagccugugcgcccugcccgacaccccgagcacccucacaccgcgguccgugcgcagcgugcccggcgagaugcggcuggcguccaucgccuucaaucaccccauccaagucgaccagcugaacagcuccuacuucaagcucagcauaccgaccaacuucuccuucggcgugacccaggaauacauccagaccacaauccagaaggucaccgucgacugcaagcaguaugugugcaacggguuccagaagugcgagcagcugcugcgcgaguacggccaguucugcagcaagaucaaccaggcccuccacggggccaacuuacggcaggacgacuccgugcgcaaccuguucgccagcgucaaguccagccaguccagccccaucauccccggcuucgggggcgacuucaacuuaacccuguuggagcccguguccaucagcaccggcagucggagcgcgcgcuccgccaucgaggaccuccuguucgacaaggugacgaucgccgacccgggguacaugcagggcuacgacgacugcaugcaacaggggcccgccagcgccagagaccugaucugcgcgcaguacgucgccggcuacaaggugcucccaccccuuauggaugugaacauggaggccgccuacaccagcucccuacucgggagcaucgcgggcgucggcuggaccgccgggcuguccucguucgccgccauccccuucgcgcaguccaucuucuaucgacugaacggaguggggaucacccagcagguccucagcgagaaccagaagcugauagcgaacaaguucaaccaggcccugggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgccucgacgugcuggagcaggaugcccagaucgaccggcugaucaacgggaggcucaccacccugaacgccuucgucgcccagcagcuggugcggagcgaguccgccgcgcucagcgcccagcuggccaaggacaagguuaacgagugcgucaaggcccaguccaagcgcagcggcuucugcgggcagggcacccacaucguguccuucguggugaacgcccccaacggccuguacuucaugcacgugggguauuaccccagcaaccacaucgaggucguguccgcguacggccucugcgacgccgccaaccccacgaacugcaucgccccuguuaacggguacuucaucaagaccaacaacacccggaucgucgacgaguggagcuacaccggcagcucauucuacagccccgagcccaucacgucccugaacaccaaguacguggcgccccaggugaccuaccagaacaucucuaccaaccugccgccgccccuccuggggaacucgaccggcaucgacuuucaggacgagcuggacgaguucuuuaagaacgucagcacguccauccccaacuucggcagccucacccagaucaacaccacccugcuggaccucacguacgagaugcugucccugcagcaggucgugaaagcccucaacgagagcuacaucgaccugaaggagcuggggaacuacaccuacuacaacaaguggcccugguacaucuggcucggcuucaucgccgggcugguggcccuggcccucugcguguucuuuauccugugcugcaccggcugcggcaccaacuguaugggcaagcugaagugcaaccgcugcugcgaccgcuacgaggaauacgaccucgagccccacaaggugcacguccacuga

SEQ ID NO: 1302 - RNA, 4062 nt, Artificial Sequence
  derived and/or modified CDS sequence (opt11) from MERS-CoV__ALA49341__S
augauccacagcguguuccugcucauguuccugcugacccccaccgagucuuacgucgacguagggccggacagcgugaaaucggccugcaucgaggucgacauccagcagaccuucuucgacaagaccuggccacgccccaucgacgugagcaaggccgaugggaucaucuacccccaggggcggaccuauuccaacauaaccaucacguaccagggccuguucccauaccaaggggaccacggggacauguacguguacagcgcgggccacgccaccggcaccacccuacaaaagcuguuugucgccaacuacucccaggacgugaaacaguucgccaauggauuugugguccgcaucggcgccgcggccaacucgacggggaccgugaucaucucccccaguacguccgccaccauccggaagaucuaccccgccuuuaugcucggcaguuccguggggaacuucagcgacggcaagaugggccgcuucuucaaccacacgcuggucuugcuccccgacgggugcggcacccugcugagggcguucuacugcauucucgagccgcgcuccggcaaucacugccccgcuggcaacagcuacaccuccuucgccaccuaucacacgccggccacagacugcagcgacggcaacuacaaccggaacgccucucugaacucauucaaggaguacuucaaccugcgcaacugcaccuucauguauaccuacaacaucacggaggacgagauccucgagugguucgguaucacccagacugcucagggcgugcaccuguucagcucccgauacguggaccuguacgggggcaacauguuccaguucgcaacccuccccgucuacgacacgaucaaguacuacagcauaaucccgcacuccauccguuccauccaguccgaccggaaggcuugggccgccuucuacguguacaagcugcagccccugaccuuucuccuagacuucagcgucgauggguacauccggcgggccaucgacugcggcuucaaugaccugucccagcuccacugcagcuacgaaucuuucgacgucgagagcggcguguacuccgugagcuccuucgaggccaagccuagcggauccgucguggaacaggccgagggcguugagugcgacuucagcccgcuucucuccgggaccccgccccagguuuacaacuucaagcgccucguguucaccaauugcaacuacaaccugacuaaguuacucagccuguucuccgucaacgacuucaucugcagccagauuagccccgccgccaucgcguccaauugcuacagcucgcugauccucgacuauuucucauacccccuguccaugaaguccgaccugagcgugagcuccgccggcccgaucagccaguucaacuacaagcaguccuucagcaaccccacgugccuaauccuggccaccgugccccacaaccuaaccacgaucaccaaacccuuaaaguacucguacauaaacaagugcagccggcugcuguccgacgaccgcacagaggucccccagcucgugaacgcaaaccaguacagccccugcguguccaucguccccagcacugugugggaggacggggacuacuaucgaaagcagcuaagcccccuggagggcggcggguggcucguggccuccggcagcacggucgcgaugaccgagcaacugcagaugggguucggcaucaccgugcaguaugggaccgacaccaacuccgugugcccgaaacuggaguucgccaacgacacgaagaucgccagccagcucggaaacugcgucgaguauucccucuacggcguaagcgggcgcggcguguuccagaacugcaccgccgucggggugcgucagcagcgcuucguguaugaugcguaccaaaaccuggucggcuacuacucugacgacggcaacuacuacugucugcgggccugcgugucggugccagucuccgugauauacgauaaggagaccaagacccacgccacccucuucgggagcguugccugcgagcacaucuccagcaccaugucccaguacagccgcucgacgcgcagcaugcugaagcggcgcgacuccaccuacggcccccuucagacgccggucgggugcgugcucggucuggugaacagcucccuguucgucgaggacugcaagcucccccuggggcagagccugugcgcccuccccgacacccccagcacccugacgccgcgguccguucgcagcgugcccggugagaugcggcuggccuccaucgccuuuaaccaccccauccaggucgaccagcucaacagcuccuacuucaaguuaagcauccccacgaacuucuccuucggcgugacccaggaguacauccagaccaccauccagaaggucacggucgacugcaagcaguaugugugcaacggguuccaaaagugugagcagcugcuccgcgaguacggccaguucugcagcaagauuaaucaggcccugcacggggccaaccugcggcaggacgauuccgugcgcaaccucuucgccagcgucaagagcagccaguccagcccgaucaucccgggcuucgggggagacuucaaccugacccugcucgagcccgugucgaucagcaccggcucccggagcgcgcgcuccgccaucgaggaccuucuguucgauaaagugaccaucgccgaucccggauacaugcagggcuacgaugauugcaugcagcaggggccggccucugcgcgggaucucaucugcgcgcaguacgucgccggcuauaaggugcugccgccccugauggacgugaauauggaggccgccuacacgagcucccuccuggggagcaucgcgggcgucggcuggaccgccgggcuguccagcuucgccgccauccccuucgcccaauccaucuucuaccgccugaacggcguggggauuacucagcagguacuaagcgagaaccagaagcugaucgcgaacaaguucaaccaggcucucggcgccaugcagaccggguucacgaccaccaacgaggccuuccggaaggugcaggacgccgugaacaacaacgcgcaggcccucuccaagcuggccagcgagcucuccaacaccuucggcgcaaucagcgccuccauaggcgacaucauccagcgucuggacgugcuggagcaggacgcgcagaucgaccgccucaucaacgggcgccugacgacgcugaacgccuucgucgcccagcagcucguacggagcgaguccgccgcgcugagcgcccagcuggccaaggacaaggugaacgagugcgucaaggcccaguccaagcgcagcggguucugcgggcagggcacccacaucguguccuucgucgugaacgcgcccaacggccucuacuucaugcacguuggcuacuaccccuccaaccacaucgaggucguguccgcguacggccucugcgacgccgccaaccccaccaacuguaucgcccccgugaacgguuacuucaucaagacgaacaacacccggaucgucgacgaguggagcuacaccggcagcuccuucuacgccccggagcccaucaccagccugaacacgaaguacguggcgccccaggugaccuaccagaauaucuccaccaaccuaccaccgccccuccuggggaauagcaccggcaucgacuuccaggacgagcucgacgaguuuuucaagaacgucuccaccagcaucccaaacuucggcucccugacucagaucaacaccacccugcucgaccugaccuacgaaaugcugagccuccagcaggucgugaaagcccugaacgaguccuacaucgaccugaaagagcucgggaacuacacguacuacaauaaguggccgugguacaucuggcucggcuucaucgccggacugguggcgcucgcccuguguguguucuucaucuuaugcugcaccggcugcgggaccaacugcauggguaagcucaagugcaaccgcugcugcgacagguacgaggaguacgaccuggagccccacaaggugcacguacacuga

SEQ ID NO: 1303 - RNA, 4062 nt, Artificial Sequence
  derived and/or modified CDS sequence (opt11) from MERS-CoV__ALA49352__S
augauccacagcguguuccugcucauguuccugcugacccccaccgaguccuacgucgacgugggcccggacagcgugaaguccgccugcauagaggucgacauccagcagacauucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgcgaacuacucccaggacgugaagcaguucgccaacggguuugugguccgcaucggcgcagcggccaacagcaccgggaccgugaucaucagucccagcaccuccgccacuauccggaagaucuacccagccuucaugcugggcagcuccguggggaacuucagcgacggaaagaugggccgcuucuucaaccacacgcucguccugcugccggacgggugcggcacccuccugcgggcguucuacugcauccuggagccccgcuccggcaaccacugccccgccggcaacagcuacaccuccuucgccaccuacuacacgccagccaccgacugcagugacggcaacuacaaccggaaugccagccucaauagcuucaaggaguacuucaaccugcgcaacugcacguucauguacaccuacaacaucacggaggaugagauccuggagugguucgggaucacccagaccgcgcagggcgugcaccucuucagcucccgguacguggaccuguacgggggcaacauguuccaguucgccacccugccggucuacgacacuaucaaguacuacagcaucaucccccacuccauccgcagcauccaguccgaucggaaggccugggccgccuucuacguguacaagcuccagccccugaccuuccugcucgacuucagcguggacggguacauccgcagagcaaucgacugcggcuucaacgaccugucccaacuacacugcucuuacgaauccuucgaugucgaaagcggaguguacuccgugagcuccuuugaggccaagcccagcggguccgucguggagcaggcugagggcguggagugcgacuucagcccgcuccuguccgggaccccgccccaggucuacaacuucaagcgccugguguucaccaacugcaacuacaacuuaacaaagcugcugagccucuucuccgucaacgacuuuacgugcucacagaucagccccgccgccaucgcguccaacugcuacagcucccugaucuuagacuacuucagcuacccccucuccaugaaguccgaccugagcgugagcuccgccgggcccaucagccaguucaacuacaagcagucguucagcaacccgaccugccugauccucgccaccgugccccacaaccugaccaccaucaccaagccccugaaguacuccuacaucaacaagugcagccgccuccuguccgacgaccgcaccgaggucccccagcuagugaacgccaaccaguacagccccugcguguccaucguccccagcacggugugggaggacggggacuacuaccggaagcagcucagcccgcuggagggcggcggguggcugguggcauccggcagcaccgucgccaugaccgagcagcuucagauggguuucggcaucaccgugcaguacgggaccgauacgaacuccgugugccccaagcuggaguucgccaaugacaccaagaucgccagccagcuggggaacugugucgaguacucccucuacggcgugagcgggcgcgggguguuccaaaacugcaccgccgucggggugcggcagcagcgauucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgaacacaucuccagcacaaugucccaguacucucgcuccacccgcagcaugcucaagcggcgcgacuccacguacggcccgcugcagacccccgucgggugcgugcugggacucguuaacagcagucuguucguagaggacugcaagcugccccucgggcagagccugugcgcccugcccgacaccccgagcacccucacgccccggucugugcgcagcgugcccggagagaugcggcuggcguccaucgccuucaaccaccccauccaggucgaccaacugaacagcuccuacuucaaguugagcaucccgacgaacuucuccuucggcgugacccaggaguacauccagaccacaauccagaaggugaccgucgacugcaagcaguacgugugcaauggguuccagaagugcgagcagcugcuacgcgaguacggccaguucugcagcaagaucaaccaggcacuccacggggccaaccugcggcaggacgacagcguacgcaaccuguucgccagcgucaaguccagccaguccagccccaucaucccgggcuucggaggcgacuucaaccucacccugcuggagcccguguccaucagcaccggcuccaggagcgcgcgcuccgccaucgaagaccuccuguucgacaaggugacgaucgccgacccgggguacaugcagggguacgacgacugcaugcagcaggggcccgccagcgcccgggaccugaucugcgcgcaguacguagccggcuacaaggugcucccgccccugauggacgugaacauggaggccgccuacaccagcucccugcucgggagcaucgcgggcgucggcuggaccgccgggcuguccagcuucgccgccauacccuucgcccaguccaucuucuaccgccugaacggcguggggauaacccagcagguccucagcgagaaccagaagcugauagcgaacaaguucaaccaggcccucggcgccaugcagacgggguucaccaccaccaacgaggccuuccggaaggugcaggacgccgugaacaacaacgcgcaggcccucuccaagcuggccagcgagcuguccaacacguucggcgccaucagcgccuccaucggcgacaucauccagcgcuuagacgugcuggagcaggacgcgcagaucgaccggcugaucaacgggcgccucacaacccugaacgccuucgucgcccagcagcuggugcggagcgaguccgccgcgcucagcgcccagcuggccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccucugcgacgccgcgaaccccacgaacugcaucgcaccggugaacggguacuucaucaagacaaacaacacccggaucgucgacgaguggagcuacaccggcagcuccuucuacgcccccgagcccaucacgagccugaacaccaaguacguggcaccccaggugaccuaccagaacaucuccaccaaccugccgccgccccuccuggggaacagcaccggcaucgacuuccaggacgagcuggacgaguucuucaagaacgucuccacgagcauccccaacuucggcagucucacccagaucaacaccacccugcuggaccucacguacgagaugcugagccugcagcaggucgugaaggcccucaacgaguccuacaucgaccugaaggagcuggggaacuacaccuacuacaacaaguggccaugguacaucuggcucggcuucaucgcagggcugguggcccuggcccucugcguguucuucauccugugcugcaccggcugcgggaccaacugcaugggcaagcugaagugcaaccgaugcugcgaccgcuacgaggaguacgaccucgagccccacaaggugcacguccacuga

SEQ ID NO: 1304 - RNA, 4062 nt, Artificial Sequence
  derived and/or modified CDS sequence (opt11) from MERS-CoV__ALA49363__S
augauccacagcguguuccugcucauguuccugcugacucccaccgaguccuacgucgacgugggcccggacagcgugaaguccgccugcaucgaggucgacauccagcagacguucuucgacaagaccuggccccgcccaaucgacgugagcaaggccgacgggaucaucuacccccaaggccggaccuacuccaacaucaccaucacguaccagggccucuucccguaccagggagaccacggugacauguacguguacagcgcgggccacgccaccggcaccacgccccagaagcuguucgucgccaacuacucccaggaugugaagcaguucgccaacggguucgugguccgcaucggcgccgccgccaacucuaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuauugcauccuggagccccgcuccgggaaccacugccccgccggcaacagcuacaccuccuucgccaccuaccacacgcccgccaccgacugcagcgacggcaacuacaaccggaacgccucucucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccaccuucccggucuacgacacgaucaaguacuacagcaucaucccccacuccauccgcagcauccagagcgaccggaaggccugggcagccuucuacguguacaagcugcagccccucaccuuccugcuggacuucagcguggacggguacauccgccgggcaauugacugcggcuucaacgaccucucccagcugcacugcagcuacgaguccuucgacgucgagagcggcguguacuccgugagcuccuucgaggccaagcccagcggguccgucguggagcaagccgagggcguggagugcgacuucagcccgcugcucuccgggaccccgccccaggucuacaacuucaagcgccugguguucaccaacugcaacuacaaccugacgaagcuccugagccuguucagugucaacgacuucacgugcagccagaucagccccgccgccaucgcguccaacugcuacagcucccucauccuggacuacuucagcuacccccuguccaugaaguccgaccucagcgugagcuccgcggggcccaucagccaguucaacuauaagcaguccuucagcaacccgaccugccugauacuggccaccgugccccacaaccucaccaccaucaccaagccccugaaguacuccuacaucaacaagugcagccggcugcucuccgacgaucgcaccgaggucccccagcuggugaacgccaaccaguacagccccuguguguccaucguccccagcacggugugggaggacggggacuacuaccggaagcaacugagcccccucgagggcggcggguggcugguggccagcggcagcaccgucgcgaugaccgagcagcugcaaaugggguucggcaucacggugcaguacgggaccgacacgaacuccgugugccccaagcucgaguucgccaacgacaccaagaucgccagccagcugggcaacugcgucgaauacucccuguacggcgugagcgggcgcggaguguuccagaacugcaccgccgucggggugcggcagcagcgcuucguguacgacgcguaccagaaccucgucggcuacuacuccgacgauggcaacuacuacugccugcgggccugcgugagcgugcccgucuccgugaucuacgacaaggagaccaagacgcacgccacccuguucgggagcguggccugcgagcacaucuccucgaccaugucccaguacagccgcuccacccgaucgaugcugaagcggagagacuccacguacggcccgcuccagacccccgucgggugcgugcugggccugguaaacagcucccucuucgucgaggacugcaagcugccccuggggcagagccucugcgcccugcccgacaccccgagcacccugacgccccgguccgugcgcagcgugcccggcgagaugcggcucgcguccaucgccuucaaccaccccauccaggucgaccagcugaacagcuccuacuucaagcugagcaucccgaccaacuucuccuucggcgugacccaggaguacauccagaccacgauccagaaggugaccgucgacugcaagcaguacgugugcaacggguuccagaagugcgaacagcuccugcgcgaguacggccaguucugcagcaaaaucaaccaagcccuccacggggccaaccuccggcaggacgacuccgugcgcaaucuguucgccagcgucaaguccagccaguccagccccaucauccccggcuucgggggcgacuucaaccugacccuccuggagcccguguccaucagcaccggcucccggagcgcgcgcuccgcgaucgaggaucuccuguucgacaaggugacgaucgccgacccgggguacaugcagggcuacgacgacugcaugcagcaagggccagccagcgcccgggaccugaucugcgcgcaguacgucgcaggcuacaaggugcugccgccacucauggacgugaacauggaggccgccuacacuagcucccucuuagggagcaucgcgggcgucggcuggaccgcugggcucuccagcuucgccgccauccccuucgcccaguccaucuucuaccgccugaacggcguggggaucacccagcagguccugucugagaaccagaagcucaucgcgaacaaguucaaccaggcccuaggggcaaugcagacgggguuuaccaccaccaacgaggccuuccggaaggugcaggaugccguaaacaacaacgcgcaggcccugucgaagcucgccagcgaacuguccaacacguucggcgccaucuccgcuuccauaggcgacaucauccagcgccuggacgugcucgagcaggacgcgcagaucgaccggcugaucaacgggcgucugaccacccucaacgccuucgucgcccagcagcuggugcggagcgaguccgcggcgcugagcgcccagcucgccaaggacaaggugaacgagugcgucaaggcccaguccaagcgcagcggcuucugcgggcagggcacccacaucguguccuucgucgugaacgcccccaacggccuguacuucaugcacgugggguacuaccccagcaaccacaucgaggucguguccgcguacggccugugcgacgccgccaaccccacgaacugcaucgccccggugaacggguacuucaucaagaccaacaauacccggaucgucgacgaguggagcuacaccggcagcuccuucuacgcccccgagcccaucacgagccucaacaccaaguacguggcgccgcagguaaccuaccagaacaucuccaccaaucugccgccgccccugcucgggaauagcaccggaaucgacuuccaggacgagcuggacgaguucuucaagaacgucuccacgagcauccccaacuucggcucccugacccagaucaacaccacccuccuggaccugacguacgagaugcucagccugcagcaggucgugaaggcccugaacgaguccuacaucgaccucaaggagcuggggaacuacaccuacuacaacaaguggcccugguacaucuggcugggcuucaucgccggacucguggcccuggcccuguguguguucuucauccucugcugcaccggcugcgggaccaacuguaugggcaagcugaagugcaaccgcugcugcgaccgcuacgaggaguacgaucuggagccccauaaagugcacguccauuga

SEQ ID NO: 1305 - RNA, 4062 nt, Artificial Sequence
  derived and/or modified CDS sequence (opt11) from MERS-CoV__ALA49374__S
augauacacuccguguuccugcucauguucuuacugacccccaccgaguccuacgucgacgugggcccggacagcguaaaguccgccugcaucgaggucgacauccagcagacguucuucgacaagaccuggccccgccccaucgacgugucaaaggccgacgggaucaucuacccccagggccggaccuauuccaacaucaccaucacguaucagggccucuucccguaccagggcgaccacggggacauguacguguacagcgcuggccacgccaccggcaccacgccccagaagcuguucgucgccaacuacucccaggacgugaagcaguucgccaacggguucgugguccgcaucggcgccgcggccaacagcaccgggaccgugaucaucucccccagcacuuccgccaccauccggaagaucuacccagccuucaugcugggcuccuccguggggaacuucucugauggcaagaugggccgcuucuucaaccacacgcucguccugcugccggacgggugcggcacccuccuucgggcuuucuacugcauccuagagccccgcuccgggaaccacugccccgccggcaacagcuacaccuccuucgcaaccuaccacacgcccgccaccgacugcagcgacggcaacuacaaccggaacgccucccucaacagcuucaaggaauacuucaaccugcgcaacugcaccuucauguacaccuacaacaucacggaagaugagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcgggguguacuccgugagcuccuucgaggccaagcccagcggguccgucguggagcaggccgaaggcguggagugcgacuuuagcccgcuccuguccgggaccccgccccaggucuacaacuucaaacgccucguguucaccaacugcaacuacaacuucacgaagcuccuaucucuauucuccgucaacgacuucacgugcagccagaucagccccgccgccaucgcguccaacugcuacagcucccucauccuggacuauuucagcuacccccuguccaugaaguccgaccucagcgugagcuccgccgggcccaucagccaguucaacuacaagcaguccuucagcaacccgaccugccugauccuggcuacggugccccacaaccucaccaccaucaccaagccccugaaguacuccuacaucaacaagugcagccggcugcucuccgacgaccgcaccgaggucccccaacuggugaacgccaaucaguacagccccugcguguccaucguccccagcacggugugggaggacggggacuacuaccggaagcagcugagcccguuagagggcggcggguggcugguggccuccggcagcaccgucgcaaugaccgagcagcugcagaugggguucgggaucaccgugcaguacgggaccgacacgaacuccguuugccccaagcucgaguucgccaacgacaccaagaucgccagccagcugggcaacugcgucgaguacucacuguacggcgugagcgggcgcggcguguuccagaacugcaccgccgucggggugcggcagcagcgcuucguauacgacgcguaccagaaccucgucggcuacuacuccgacgacggcaacuacuacugccugcgggccugcgugagcguacccgucuccgugaucuacgacaaggagaccaagacgcacgccacccuguucgggagcguugccugcgagcacaucuccagcacgaugucccaguacagccgcuccacccgcagcaugcugaagcggcgcgacaguacguacggcccgcuccagacccccgucgggugcguacugggccuggugaacagcucccucuucgucgaggacugcaaacugccccuggggcagagccucugcgcccugcccgacacaccgagcacccugacgccccgguccgugcgcagcguucccggcgagaugcggcucgccuccaucgccuucaaccaccccauccaggucgaccagcugaauagcuccuacuucaagcugagcaucccgacuaacuucuccuucggcgugacccaggaguacauccagaccacgauccagaaggugaccgucgacugcaagcaguacgugugcaacggguuccagaagugcgagcagcuccugcgcgaguacggccaguucugcagcaagaucaaccaggcccugcacggggccaaccuccggcaggacgacucugugcgcaaccuguucgccagcgucaaguccagccaguccagccccaucauccccggcuucgggggcgacuucaaccugacccuccuggagcccgugagcaucucaaccggcucccggagcgcgcgcuccgccaucgaggaccuccuguucgacaaggugacgaucgccgacccgggguacaugcagggcuacgacgauugcaugcagcaggggcccgccagcgcccgggaccugaucugcgcgcaguaugucgccgguuacaaggugcugccgccccucauggacgugaacauggaagccgccuacaccagcucccugcugggcagcaucgcuggcgucggcuggaccgccgggcucuccagcuucgccgccauccccuucgcccaguccaucuucuaccgccugaacggcguggggaucacccagcagguccugagcgagaaccagaagcucaucgcgaacaaguucaaccaggccuuaggcgccaugcagacgggguucaccaccaccaacgaggccuuccggaaggugcaggacgccgugaacaacaacgcgcaggcccuguccaagcucgccagcgagcuguccaacacguucggcgccaucagcgccuccaucggcgacaucauccagcgccuggacguguuagagcaggacgcgcagaucgaccggcugaucaacgggcgccugacuacccucaacgccuucgucgcccaacagcugguucggagugaauccgccgcgcugagcgcccagcucgccaaggacaaggugaacgagugugucaaggcccaguccaagcgcagcggcuucugcgggcagggcacccauaucguguccuucgucgugaacgcccccaacggucuguacuucaugcauguaggguacuaccccagcaaccacaucgaggucguguccgcguacggccugugcgacgccgcuaaccccacgaacugcaucgccccggugaacggguacuucaucaagaccaauaacacacggaucgucgacgaguggagcuacaccggcagcuccuucuacgcccccgagcccaucacgagccucaacaccaaguacguggcgccccaggugaccuaccagaacaucuccaccaaccugccgccgccccugcucagcaauuccaccgggaucgacuuccaggacgagcuggacgaguucuucaagaaugucagcacguccauccccaacuucggcucccugacccagaucaacaccacccuccuggaccugacguacgagaugcucuccuuacagcaggucgugaaggcccugaacgagagcuacaucgaccucaaggagcugggcaacuacaccuauuacaacaaguggcccugguacaucuggcugggguucaucgccggccucgucgcccuggcccugugcguguucuucauccucugcugcaccgggugcggcaccaacugcauggggaagcugaagugcaaccgcugcugcgaccgcuacgaggaguacgaccuggagccccacaagguacacguccacuga

SEQ ID NO: 1306 - RNA, 4062 nt, Artificial Sequence
  derived and/or modified CDS sequence (opt11) from MERS-CoV__ALA49396__S
augauccacagcguguucuuacucauguucuuacugacucccaccgaguccuacgucgacguaggcccggacagugugaagucagccugcaucgagguagacauccaacagacguucuucgacaagaccuggccccgccccauagacgugagcaaggccgacgggauuauuuauccccaggggcggaccuacucaaacaucaccaucacguaccagggucuuuucccguaccagggcgaccacggggauauguacguguacagcgcgggccacgcuaccggcaccacgccccagaagcuguucgucgccaacuacucccaggacgugaagcaguucgccaacggguucgugguacgcaucggcgccgcggccaauagcacggggaccgucaucaucucacccagcaccuccgccaccauacggaagaucuaccccgccuucaugcuggggucuuccgugggcaacuucucugacggcaagaugggccgcuucuucaaccacacgcucgugcugcugccggacgggugcggcacccuccugcgggcguucuacugcauccuggagccccgcuccgggaaucacugccccgccggcaacagcuacaccuccuucgccacguaucacacgccggccaccgacuguuccgacggaaacuacaaccggaacgccucccucaacagcuucaaagaauacuuuaacuugcggaacugcacauucauguacaccuauaacaucacggaggacgagauccuggaaugguucgggaucacccaaaccgcacagggcgugcaccucuucagcagccguuacguggaccuguacgggggcaacauguuccaguucgcuacauugccggucuacgacacuauaaaguacuacagcauaaucccccacucgaucaggucgauccagucugaucggaaggccugggcagcauucuacguauacaagcugcagcccuuaaccuuccuguuagacuucagcguggacgguuacaucagacgggcuaucgacugcggcuucaacgaccugucgcaauuacacuguagcuacgaauccuucgacgucgagucgggaguguacucggugucaaguuucgaggccaagcccagcgggucugucguggaacaggccgagggcguggagugcgacuucagcccgcuauuauccgggacgccuccccaggucuauaacuuuaagcgccugguguucacaaacugcaacuacaaccucacgaaacugcuguccuuauuuuccgucaacgacuucacgugcucucagaucagccccgccgcaaucgcguccaacugcuacagcucccugaucuuggacuacuucagcuauccccucucuaugaaauccgaccugagcgugagcuccgccgggcccaucagccaguucaacuacaagcaauccagcucaaacccgacaugcuuaauauuagccacagugccccacaaccugaccaccaucaccaagccgcugaaguauagcuacaucaacaagugcucccgccuccugagcgacgaccgcaccgagguaccccagcuggugaacgcgaaccaguacuccccgugcguuaguaucguacccucaacggucugggaggacggggacuacuaccggaaacagcucagcccgcuggaggguggcgggugguuggucgcaagcggcagcacagucgcgaugaccgagcagcuccagaugggauucggcauaaccgugcaguacgggaccgacacgaacagcgugugccccaagcuggaguucgccaacgacacgaaaaucgccucccagcugggcaauuguguagaguauuccuuauacggcguguccgggcgcgguguuuuccagaacugcacggccgucggggugcggcagcagcgcuucgucuacgacgcguaccaaaaccuggucggcuacuacagcgacgacggcaacuacuauugccugcgggccugcguguccguccccgucagcgugaucuacgacaaggagaccaaaacgcacgccacccuguucggguccguagccugugagcacaucagcucaacuaugagccaguacucccgcagcacccgcuccaugcuuaaacggcgcgacagcacguacgguccgcuccagacccccgucgggugcgugcuaggucucgucaauuccagccuguucguggaggacuguaagcugccauuggggcagagucugugcgccuuacccgacaccccguccacccucacgccccggagcguccguuccgugcccggcgagaugcggcuagcgucuaucgccuucaaccacccaauccaggucgaccagcugaacuccuccuacuucaaacucuccaucccgaccaauuucagcuucggcgugacccaggaguauauucaaaccacgauccaaaaggugacggucgacugcaagcaauacgugugcaacggguuccagaagugugaacagcugcugcgcgaguacggccaguucugcuccaagaucaaccaagcccuccacggggccaaccugcggcaggaugacagcgugcgcaaccucuucgccuccgucaagagcucccagucaucccccaucauccccggcuucgguggcgacuucaaccucacccuguuggaacccguuagcaucucaaccggcucacgguccgcgcgcagcgccaucgaggaccugcuguucgacaaggucacgaucgcagacccgggguacaugcaaggauaugacgauugcaugcagcaggggcccgccagcgccagagaccugaucugcgcgcaguacgucgccggcuauaaggugcucccgccccugauggacgugaacauggaggccgcguacaccuccucgcugcucggcuccaucgcgggcgucgguuggaccgcugggcuuagcuccuucgccgccaucccuuucgcccagagcaucuucuaccgccugaacggcguggggaucacccagcagguacuguccgagaaccaaaagcugaucgccaacaaguucaaccaggcccugggcgccaugcagacgggguucacgacaaccaacgaggcuuuccgaaaggugcaagacgccgugaauaacaaugcgcaggcccucucaaaacuggcguccgaacugucgaacacguucggcgccaucuccgccucaaucggugacaucauccagcgccucgacguccuggagcaagacgcgcagauugauagacugaucaacggacgccucacgacccugaacgcauuugucgcccagcagcugguccguucagagagcgccgcgcucuccgcccagcuggccaaggacaagguuaacgaaugcguuaaagcccaaagcaagcgcuccggcuuuugcgggcagggcacucacaucgugaguuucguagugaacgcuccgaacggccuauauuucaugcacgugggguauuaccccuccaaccacaucgagguugugagcgcguacgggcugugcgacgccgcaaaccccacgaauuguaucgccccugugaacggguacuucaucaagaccaacaauacccggauugucgacgaguggucguacacgggguccagcuuuuacgcccccgagcccauaaccucccugaacaccaaguacguggcgccccaggugaccuaccagaacaucuccaccaaccucccgccgccccuccuguccaacagcacggggaucgauuuccaagacgaacuggacgaguucuucaagaacgucucaacgagcauccccaacuucggcagucucacccagaucaacaccacccugcuugaccucacauacgagaugcugagccuacaacagguagugaaggcccucaacgaguccuacaucgaccugaaggaacugggcaacuauacauacuacaacaaauggcccugguacaucuggcucggguucauugccggccucguugcgcuggcccucugcguguucuucauccucugcugcaccgggugcggcaccaauugcauggggaagcugaagugcaaccgcugcugugacagguacgaggaguacgaccucgagccccacaaaguacacguucacuga

SEQ ID NO: 1307 - RNA, 4062 nt, Artificial Sequence; identical to SEQ ID NO: 395
  derived and/or modified CDS sequence (opt11) from MERS-CoV__ALA49451__S

SEQ ID NO: 1308 - RNA, 4062 nt, Artificial Sequence; identical to SEQ ID NO: 396
  derived and/or modified CDS sequence (opt11) from MERS-CoV__ALA49473__S

SEQ ID NO: 1309 - RNA, 4062 nt, Artificial Sequence
  derived and/or modified CDS sequence (opt11) from MERS-CoV__ALA49583__S
augauucacagcguguuccugcucauguuucugcugacccccaccgaguccuacgucgacgucggcccagacagcguaaaguccgccugcaucgaggucgacauccagcagacguucuucgacaagaccuggccacgcccgauugacgugagcaaggccgacgggaucaucuacccucagggacggaccuacuccaacaucacgaucacguaccagggccucuucccuuaucagggugaccacggcgacauguacguguacagcgcgggccacgccaccggcaccacgccccagaagcuguucgucgcgaacuacucccaggacguuaagcaguucgccaacggguucgugguccgcaucggcgccgcggccaacucaaccgggaccgugaucaucucccccagcaccuccgccaccauccguaagaucuaccccgcauucaugcugggcagcuccguggggaauuucagcgacggcaaaaugggcagguucuucaaccacacacucguccugcugccggacggcugcggcacccuccugcgggcguucuacugcauccuggagccccgcuccgggaaccacugccccgccggcaacucauacaccuccuuugccaccuaccauacgccggccaccgacugcagcgacggcaacuauaaccggaacgccucccucaacagcuucaaggaguacuucaaccugcgcaacugcaccuucauguacaccuacaacaucacggaggacgagauccuggagugguucgggaucacccaaaccgcgcagggcgugcaccucuucagcucucgguacguggaccuguacgggggcaacauguuucaguucgccacacugccgguauacgacacgauuaaguacuacucaaucaucccacacuccauccgcagcauccagucugaccggaaggcgugggccgccuucuacguguacaagcuccagccacugaccuuccugcucgacuucagcguggacggguacauccgccgggcgaucgacugcggcuucaacgaccugucccagcugcacugcagcuaugaguccuucgacgucgagucuggcguguacuccgugagcuccuucgaggccaaaccgucuggguccgucguggagcaggccgagggcguggagugcgacuucagcccccuccuguccgggaccccgccccaggucuacaacuucaagcgccugguguucaccaacugcaacuauaaucucacgaagcugcugucccucuucuccgucaaugacuucacaugcagccagaucagccccgccgccaucgcguccaacugcuacagcucccugauccuggacuacuucagcuauccccucuccaugaaguccgaccugagcgucagcuccgccgggccgaucagccaguucaacuacaagcaguccuucuccaacccgaccugccugauccucgccaccgugccccacaaccugaccacgaucaccaagccccugaaguauuccuacaucaacaaguguagccggcuccugagugacgaccgcaccgagguuccccagcuggugaacgccaaccaguacagccccugcguauccaucguccccagcacgguaugggaggacggggacuacuaccggaagcagcucagcccgcuggagggcggcggguggcuuguggccuccgggagcaccgucgcgaugaccgagcaacuccagaugggcuucggcaucaccgugcaguacgggaccgacacgaacuccgugugcccaaagcuggaguucgccaacgacaccaagaucgccagccagcugggcaacugcgucgaguacucacucuacggcgugagcgggcgcggcgucuuucaaaacugcaccgccgucggcgugcggcagcagcgcuuuguguacgacgcguaucagaaccuggucggcuacuacuccgacgacggcaacuacuacugccugcgggccugcgugagcgugcccgucagugucaucuaugacaaggagaccaagacccacgcuacacuguuugggagcguggccugcgagcacauuuccagcaccaugucccaguacagccgcuccacccgcagcauguugaagcggcgcgauuccacguacggcccgcugcagacccccgucgggugcgugcuuggccucgugaacagcucccuguucgucgaggacugcaaacugccccucgggcagucucugugcgcucugccugacacuccgaguacccucacgccccgguccguucgcagcgugcccggcgagaugcggcuggcgagcaucgccuucaaccaccccauccaggucgaucagcuuaacagcuccuacuucaaacuuagcaucccgaccaacuucuccuucggcgugacccaggaguacauccagaccacgauccagaaggugaccguagacugcaagcaguacgugugcaacggcuuccagaagugcgagcagcugcugcgcgaguacgggcaguucugcagcaagauaaaccaggcccuccacggggccaaccugcggcaggaugacuccgugcgcaaccuguucgccagcgucaaguccagccaguccagccccaucauccccggcuuugggggcgacuucaaccucacacuguuggagcccgugaguauaagcaccggcucccggagcgcgcgcuccgccaucgaggaccuccuguucgacaagguuaccaucgccgacccgggguacaugcagggcuacgacgacuguaugcagcaggggcccgccagcgccagagaccugaucugcgcgcaguaugucgccggcuacaaggugcucccgccccugauggacgugaacauggaggccgccuacaccagcucccugcuugggagcaucgcgggcguuggcuggaccgccgggcuguccagcuucgccgccauccccuucgcccaguccaucuucuauagacugaauggcguggggaucacccagcagguccucagcgagaaccagaagcugaucgcgaacaaguucaaccaggcccugggcgccaugcagacgggguucaccaccaccaacgaggccuuccggaagguucaagacgcugugaacaacaacgcgcaggcccucuccaaguuggccagugagcuguccaacacuuucggcgccaucagcgccuccaucggcgacaucauccaacgccuagacgugcuggagcaggacgcgcagaucgaccggcugaucaacgggcgccucaccacccuaaacgccuucguagcccagcagcuggugcggagcgaguccgccgcgcucagcgcccaguuggccaaggacaaggugaacgagugcgucaaagcccagaguaagcgcagcggcuucugcgggcagggcacccacauaguguccuucgucgugaacgcccccaacggccuguacuucaugcacgugggguacuaccccagcaaucacauugaggucgugagcgcguacggccucugcgacgccgccaaccccacgaacugcaucgccccagugaacggguacuucaucaagaccaacaacacccguaucguagacgaguggagcuacaccggcagcuccuucuacgcccccgagcccaucacgagccugaacaccaaauacguagcgccccaagugacuuaccaaaacaucuccaccaaccuaccgccgccccuccuggguaacagcaccggcaucgacuuccaggacgagcuggacgaguucuucaagaacguauccacgucaaucccuaacuucggcucucucacccagauaaacaccaccuugcuggaccucacguacgagaugcuuagccugcagcaagucguaaaggcccucaacgaguccuauaucgaccugaaggagcuggggaacuacaccuacuacaacaaguggcccugguacaucuggcucggcuuuauagccgggcugguggccuuagcgcuaugcguguucuucauccuguguugcaccggcugcgggaccaacugcauggggaagcugaaguuuaaccgcugcugcgaccgcuaugaggaguacgaccucgagccccacaaggugcacguccacuga

SEQ ID NO: 1310 - RNA, 4062 nt, Artificial Sequence; identical to SEQ ID NO: 398
  derived and/or modified CDS sequence (opt11) from MERS-CoV__ALA49649__S

SEQ ID NO: 1311 - RNA, 4062 nt, Artificial Sequence
  derived and/or modified CDS sequence (opt11) from MERS-CoV__ALA49660__S
augauacacagcguguuccugcucauguuccugcuuacccccaccgaauccuaugucgaugugggcccggacagcgugaaguccgccugcaucgaggucgacauccagcagacuuucuucgacaagaccuggccccgccccaucgacgugagcaaggccgacgggaucaucuacccccaggggaggaccuacuccaacaucaccaucacguaccagggccucuucccguaccagggcgaccacggggacauguacguguauagcgcgggccacgccaccgguaccacgccccagaaacuguucgucgccaacuacucccaggacgugaagcaguucgcgaacggauucguaguccgcaucggcgccgcggccaacagcaccgggacggugauaaucuccccaucaaccuccgccaccauccggaaguucuaccccgcuuucaugcugggcagcuccguggggaacuucagcgacgggaagauggggcgcuuuuucaaccacacacucguccugcugccggacgggugcggcacccucuugcgggcguucuacugcauccuggagccccgcuccgggaaucacugccccgccggcaauucauacaccuccuucgccacuuaccacacgcccgccaccgacugcagcgacggcaacuacaaccggaacgccagccucaacagcuucaaggaguauuucaaucugcgcaacugcaccuucauguacacauacaauaucacggaggacgagauccuggagugguucgggaucacucagaccgcccagggcgugcaccucuuuaguucccgguacguagaccuguacgggggcaauauguuccaguucgccacccugccgguuuacgacacgaucaaguacuacagcaucaucccccacuccauucgcagcauccaguccgaccggaaggccugggccgccuucuacgucuacaagcuccagccccucacguuccugcucgacuucucaguggacggguacauccgccgggcgaucgacugcgguuucaacgaccugucccagcugcacugcagcuacgaguccuucgacgucgagucgggcguguacuccgugagcuccuucgaggccaagcccagcgguuccgucguggagcaggccgagggcguggagugcgacuucagcccgcuccuguccgggaccccgccccaggucuauaacuucaagcgccugguguucaccaacugcaauuacaaccucacgaagcugcugagcuuauucucagucaacgauuucacgugcagccagaucagccccgccgccaucgcgagcaacugcuacuccucccugaucuuggacuauuucagcuaucccuuaagcaugaaguccgacuugucugugagcuccgccgggcccaucagccaguucaacuacaagcaguccuucagcaacccgaccugccugauccucgccaccgugccucacaacuuaaccacuauuaccaagccacugaaguauuccuacaucaacaagugcucucggcugcuguccgacgaccgcaccgaggucccccagcuggugaacgccaaccaguacagccccugugugagcaucguccccagcacggugugggaggacggagauuacuacagaaagcagcucagcccucuggagggcggcggguggcugguggccuccggcuccaccgucgcgaugaccgagcagcuccagaugggguucggcaucaccgugcaguacgggaccgacacgaacuccgugugccccaagcuggaguucgccaacgacacuaagaucgccucccagcugggcaacugcgucgaguacucccucuacggcgugagcgggaggggcguguuccagaauugcaccgccgucggggugcggcagcagcgcuucguguaugacgccuaccagaacuugguaggcuacuacuccgacgacggcaacuacuacugucugcgggccugcgugucaguaccaguuuccgugaucuacgacaaggagaccaagacgcacgccacccuguucgggagcguggccugugagcacaucuccaguaccaugucccaguacagccguuccacccgcagcaugcucaagcggcgcgacuccaccuacggcccgcugcagacccccgucgggugcgugcugggccucgucaauucguccuuauucguggaggacugcaagcugccacucggucagucccugugcgcccugcccgacaccccgagcacccucacuccccgguccgugcgcagcgugcccggcgagaugcggcucgcguccaucgccuucaaccaccccauccaggucgaccagcugaacagcuccuacuucaagcucagcaucccgaccaauuucuccuucggcgugacacaggaguacauccagaccacgauccagaaggugaccgucgacugcaagcaguacguaugcaacggguuucagaagugcgagcagcuuuuacgcgaguacggacaguucugcagcaagaucaaccaggcccuccacggugccaaccugcggcaggacgacuccgugcgcaaccuguucgcaagcgucaaguccagccagaguagccccaucauccccggcuucgggggcgacuucaaccucacccuguuagagcccguguccauuagcacuggcucccggagcgcgcgcuccgccaucgaggaccuccuguucgacaaggugacgaucgccgacccgggguacaugcagggcuacgaugauugcaugcagcagggucccgccagcgcccgggaccugauaugcgcgcaguacgucgccggcuacaagguacucccgccccugauggacgugaacauggaagccgccuacaccagcucccugcuagggagcauugcgggcguuggcuggaccgccgggcuguccagcuucgccgccauccccuucgcucaguccaucuucuaccgccugaacggcgugggaaucacccagcagguccucagcgauaaccagaaacuuaucgcgaacaaguucaaccaggcccugggcgccaugcaaacgggguucaccaccaccaacgaggccuuccggaaggugcaggacgccgugaacaacaacgcgcaggcccucuccaagcuggccagcgagcucuccaacacguucggcgccaucucagccuccaucggcgacaucauccagcgccucgacgugcuggagcaggacgcgcagaucgaccggcugaucaacgggcgccucacaacccugaacgccuucgucgcccagcagcuggugcggagcgaguccgccgcgcucagcgcccaauuagccaaggacaaggugaacgagugcgucaaggcccaguccaagcgaagcggcuucugcggacagggcacccacaucguguccuucgucgugaacgcccccaacggccuguacuucaugcacgugggcuacuaccccagcaaucacaucgaggucguguccgcguacggccucugcgacgccgccaaccccacgaacugcaucgccccgguaaacggguacuucauaaagaccaacaacacccggaucgucgacgaguggagcuacaccggcagcucuuucuacgcccccgagcccaucacuagccugaacaccaaguacguggcgccccaggugacguaccagaacaucuccaccaaccugccgccgccccuccucagcaacuccacugggauagacuuccaggacgagcucgacgaguucuucaagaacgucagcacguccauccccaacuucggcagccucacccagaucaacaccacccugcuggaccucacauacgagaugcugucccugcagcaggucgugaaggcccucaacgagagcuacaucgaccugaaggagcugggcaacuacaccuacuacaacaaguggcccugguacaucuggcucggguucaucgccggccugguggcccuggcccucugcguguucuucaucuugugcugcaccgggugcggcaccaauuguauggggaagcugaagugcaaccgcugcugcgaccguuacgaagaguacgaccucgagccccacaagguacacguccacuga

SEQ ID NO: 1312 - RNA, 4062 nt, Artificial Sequence; identical to SEQ ID NO: 400
  derived and/or modified CDS sequence (opt11) from MERS-CoV__ALA49671__S

SEQ ID NO: 1313 - RNA, 4062 nt, Artificial Sequence; identical to SEQ ID NO: 401
  derived and/or modified CDS sequence (opt11) from MERS-CoV__ALA49682__S

SEQ ID NO: 1314 - RNA, 4062 nt, Artificial Sequence
  derived and/or modified CDS sequence (opt11) from MERS-CoV__ALA49803__S
augauccacagcguguuccuacucauguuccugcucacccccaccgaguccuacgucgacgugggcccggacagcgugaaauccgccugcaucgaggucgacauccagcagacguucuucgacaaaaccuggccgcgucccaucgacguuagcaaggccgacgggaucaucuauccccagggccggaccuacuccaauaucaccaucacguaucagggccucuuucccuaccagggcgaccacggggaucgcuacguguacagcgcgggccacgccaccggcaccacgccccagaagcuguucgucgccaacuacucccaggacgugaagcaguucgccaacggguucguuguccggaucggcgccgcggcuaacagcaccgggaccgugauuaucucccccagcaccuccgccaccaucaggaagaucuaucccgccuucaugcugggcagcuccguugggaacuucagcgauggcaagaugggccgguucuucaaccacacgcucgugcugcuaccggacgggugcggcacccucuugcgcgcuuucuacugcauccuggagccccgguccgggaaccacugcccugccggcaacagcuacaccucauucgccaccuaccacacgcccuccacugacugcuccgacggcaacuacaaccgcaacgccagccucaauagcuucaaggaguacuucaaccugcggaacugcaccuucauguacaccuacaacaucacggaggacgagauccuggagugguuuggaaucacccagaccgcccagggugugcaccucuucuccucacgcuacguggacuuguacgggggcaacauguuccaauucgcgacccugccggucuacgacacgaucaaguacuacuccaucaucccccacagcauccguuccauccagagcgacaggaaggcgugggccgccuuuuacguguacaagcuccaaccccugaccuuccugcucgacuucuccguggacgguuacauccggcgcgccaucgacugcggcuucaacgaccugagccaguugcacugcuccuacgagaguuuugacgucgaguccggaguguacagcguguccagcuuugaggcgaagcccuccgggagcgucguggagcaggccgagggcguggagugcgacuucagcccgcuccugagcgggaccccgccccaggucuacaacuucaagcggcugguuuucacuaacugcaacuacaaccucacgaagcugcugucccucuucagcgucaacgacuucacgugcucucagaucuccccugccgccaucgccagcaacugcuacaguagccugauccuggacuacuucaguuacccccucagcaugaaguccgaccuuagcguguccagcgcggggcccaucucccaguucaacuacaagcaauccuucuccaacccgaccugccugauccucgccaccgucccccacaaccugaccaccauaacaaagccccugaaguacagcuacauuaacaaguguucccgccucuugagcgacgaccggaccgaggucccccagcuggugaacgccaaccaguacucccccugcgugucuaucguccccagcacggugugggaggacggugacuacuaccgcaaacagcucagcccacuggaaggcgggggaugguuaguggccagcggcuccaccgucgccaugaccgagcagcuccagaugggguucggcaucaccgugcaguacgggaccgacacgaacagcgugugccccaagcuggaguucgcgaacgauaccaagaucgccucccagcugggcaacugcguagaguacagccucuacggcguguccgggcggggcguauuccagaacugcaccgccgucggggugaggcagcaacgguucguauacgacgccuaccagaaccucgucggcuacuacagcgacgacggcaacuacuacugcuuacgcgcuugcguguccguucccgucagcgugauauaugacaaggagaccaagacgcacgccacccucuucggguccguggccugcgagcacaucagcuccaccaugucccaguacucccgcagcacccgguccaugcucaagcgccgggacagcacguacggcccgcuacagacccccgucgggugcguguugggccucgugaauagcagccuguucgucgaggacugcaagcucccccucgggcaaagccugugcgcccugcccgacaccccguccacccucacgccccgcagcgugcgguccgugcccggugagaugcgccuggccagcaucgcguucaaccaccccauccaggucgaccagcugaacuccagcuacuucaagcucuccauccccaccaacuuuagcuucggagugacccaggaguacauccaaaccacgauccagaaggugaccgucgacuguaagcaguacgugugcaacggguuccagaagugugagcagcugcugcgggaauacggccaguucugcuccaagaucaaccaggcccuccacggggccaaccugcgccaggacgacagcgugcggaaccuguucgccuccgucaagagcucccagucaucccccaucauccccggcuucgggggcgacuucaacuugacgcugcuggagcccguuagcauauccaccggcagccgcuccgccagaagcgcgaucgaagaccuccuguucgacaaggugacaauagccgacccgggguacaugcagggcuaugacgacugcaugcagcaaggccccgccagcgcccgcgaccugaucugugcccaguacguagcgggcuacaagguccucccgccccugauggacgugaacauggaggccgccuacaccuccagccugcucgggucgaucgcuggcgucggcuggaccgcggggcucagcaguuucgccgccauccccuucgcacagagcaucuucuacagacugaacggcgugggcaucacccaacagguccucuccgagaaucagaaguuaaucgccaacaaguucaaccaggcacugggcgccaugcagacaggauucaccaccaccaacgaggcguuccgcaaggugcaggacgccgugaacaacaacgcccaggcgcucucuaagcuggccuccgagcugagcaacacguucggcgccaucuccgccagcaucggcgacaucauucagcgucuagacgugcuggagcaggacgcacagauagaccgccuuauaaacgggaggcucaccacccugaacgcguucgucgcccagcagcugguucgaucggagagcgccgcacucuccgcgcagcucgccaaggacaaggugaacgagugcguaaaggcccagagcaagcgguccgguuucuguggacagggcacgcauaucgugucuuucgucgugaacgcccccaacggccuguacuucaugcacgugggguacuaccccuccaaccacaucgaggucgugagcgccuacggccucugugacgcggccaaccccacgaacugcaucgcccccgugaacggguacuucaucaagaccaacaacacccgcgucguggacgaguggagcuauaccggcuccuccuucuacgcccccgagcccaucacaucccugaacaccaaauacguggcgccccaggucaccuaccagaacaucagcacaaaccugccaccgccccuccuguccaacagcaccgggaucgacuuccaagacgagcuggacgaguucuucaagaacgugucaacgagcauccccaauuucggcucccucacccagauaaacaccacccugcuggaccucacguacgagaugcugagccugcagcaggucgugaaggcccucaacgaguccuacaucgaccugaaggagcugggcaacuacaccuacuacaacaaguggccuugguauaucuggcucgguuucauagccggccugguggcccuugcccucuguguauucuucauccugugcugcacggggugcgguaccaacugcaugggaaagcugaagugcaaucgcugcugcgaccgguacgaggaguacgaccucgagccacacaagguucacgugcacuaa

SEQ ID NO: 1315 - RNA, 4062 nt, Artificial Sequence
  derived and/or modified CDS sequence (opt11) from MERS-CoV__ALA49836__S
augauccacuccguguuccugcucauguuccucuuaacccccacagaguccuacguagacgugggcccagacagcgugaaauccgccugcaucgaggucgacauccagcagaccuucuucgacaagaccuggccccgccccaucgacgugagcaaagccgacgguaucaucuacccccagggcagaaccuacuccaacaucaccaucacguaccagggccucuucccguaccagggcgaccacggggacauguacgucuacagcgcaggccacgccaccggcaccacgccccagaagcuguuugucgccaacuacucccaggacgugaaacaguucgccaacggguucgugguccgcaucggcgccgcggccaacagcaccggaacagugaucaucagccccagcaccagcgccaccauccggaagaucuaccccgccuucaugcugggcagcuccguggggaacuucagcgacggcaagaugggccgcuucuuuaaccacacgcucgucuuacugcccgaugggugcggcacccuucugagggcguucuacugcauccuggagccgcgcuccgggaaccacugccccgccggcaacucuuacaccuccuucgccaccuaccacacucccgccaccgacugcagcgacggcaacuacaaucggaacgccucccucaacagcuucaaggaguacuucaaccugcgcaacugcaccuucauguauacguacaacaucacggaagacgagauccuggagugguucgggauuacccagaccgcgcagggcgugcaccucuucagcagccgguacguggaccuguacggaggcaauauguuccaguucgccacccugccggucuacgacacgaucaaguacuacagcaucaucccccacuccauccgcagcauccaguccgaccggaaagccugggccgccuucuacguguacaagcuccagccccugaccuuccugcucgacuucagcguggacggguacauccgccgggcaaucgacugcggcuucaacgaccugucccagcugcauugcagcuacgaguccuucgacgucgagagcggcguguacuccgugaguucuuucgaggccaagcccagcggguccgucguggagcaagccgagggcguggagugcgauuuuagcccgcuccuguccgggaccccgccacaggucuacaacuucaagcgccugguguucaccaacugcaacuacaaccucacaaaacugcugagccucuucuccgucaacgacuucacgugcagccagaucagccccgccgccaucgcgucaaacugcuacagcucccugauccuagacuacuucucauacccccucuccaugaagucugaccugucggugagcucugccgggccgaucagccaguucaacuacaagcaguccagcuccaacccgacgugccugauccucgccaccgucccccacaaccugacgaccaucaccaagccccugaaguacagcuacaucaacaaaugcucccggcuccugucagacgaccgcacagaggucccccagcuggugaacgccaaccaguacucccccugcgugagcaucguccccagcacugugugggaggacggggacuacuaccggaagcaacucuccccgcuggagggcggcggguggcugguggccagcggcuccaccguugcgaugaccgaacaacuccaaaugggguuuggcaucaccgugcaauacgggaccgacacgaacagcgugugccccaagcucgaguucgccaaugacaccaagaucgccucccagcugggcaacugcgucgaguacagccucuauggcguguccggccggggcguguuccagaacugcaccgccgucggcgugcggcagcagagguuuguguacgacgcguaccagaaccuggucggcuacuacucugacgacggcaacuacuacugccugcgggccugcgugucugugcccgucagcgugaucuacgacaaggagaccaagacgcacgccacucuguucggguccguggccugcgagcacaucucauccaccaugagccaguacucccgcagcacccgcaguaugcucaagcggcgcgacagcacguacggcccauugcagacccccgucgguugcgugcugggccucgugaacuccagccuguucgucgaggacugcaagcugccccucgggcagagccugugcgcccugcccgacacccccuccacccucacgccccggagcgugcgcuccgugcccggcgagaugcggcuggcgucuaucgccuucaaccaucccauccaggucgaccagcugaacuccagcuacuucaagcucuccaucccgaccaacuucagcuucggcgugacccaagaguacauccagaccacuauccagaaggugaccgucgacugcaagcaguacgugugcaacggguuccagaagugcgagcagcugcugcgcgaguacggacaguucugcuccaagaucaaccaggccuugcacggggccaaccucaggcaagacgacagcgugcgcaaccuguucgccagcgucaagagcucccagagcagccccaucaucccuggcuucgggggcgacuucaaccucacccugcuggagcccgugagcaucaguaccggcagccgguccgcgcgcagcgccaucgaggaucuccuguucgacaaggugacgaucgccgacccggguuacaugcaaggcuacgacgacugcaugcagcaggggcccgccucugcccgggaccugaucugcgcgcaguacgucgcuggcuacaaggugcuaccgccccugauggacgugaauauggaggccgccuacaccuccagccugcucggguccaucgcgggcgucggcuggacggccgggcugagcuccuucgccgccauccccuucgcccagagcaucuuuuaccgccugaacggcguggguaucacccagcaaguccucuccgagaaccagaagcugaucgcaaacaaguucaaccaggcccugggcgccaugcagacgggguucaccaccacaaacgaggccuuccggaaggugcaggacgccgugaacaacaacgcgcaggcccucagcaagcuggccagcgagcuguccaauacguucggcgccaucuccgccagcaucggcgacaucauccagcgcuuagacguucuggagcaggaugcgcagaucgaccgguugauuaaugggcgccucaccacccugaacgccuuugucgcccagcagcugguucgguccgagagcgccgcgcucucugcccagcuggccaaggacaaggugaacgagugcgucaaggcccagagcaagcgauccggcuucugcgggcagggcacccacaucgugagcuucgucgugaacgcuccuaacggccuguacuucaugcacgucggguacuaccccuccaaccacauagaggucguuagcgcguacggccucugcgacgccgccaacccaacgaacugcaucgccccgguuaacggguauuucaucaagaccaauaacaccaggaucgucgacgaguggucuuacacgggcuccucauucuacgcccccgagcccaucacgucccugaacaccaaauauguggcgccccaggugaccuaucagaacaucagcaccaaccugccgccuccccuccuagggaacuccaccggcaucgacuuccaggacgagcuggacgaguucuucaagaacgucaguacauccauccccaacuucggcucgcucacccagaucaacaccacccugcucgaccucacguacgagaugcugucccugcagcaggucgugaaggccuugaacgagagcuacaucgaccugaaggagcuggggaacuacaccuacuacaacaaguggcccugguauauuuggcucggguucaucgccggccugguggcccuggccuugugcguguuuuucauccugugcugcaccgggugcgggaccaauugcaugggcaaacugaagugcaaccgcugcugcgaccgcuacgaagaguacgaccucgagccccauaaggugcacgugcacuga

SEQ ID NO: 1316 - RNA, 4062 nt, Artificial Sequence; identical to SEQ ID NO: 404
  derived and/or modified CDS sequence (opt11) from MERS-CoV__ALA49957__S

SEQ ID NO: 1317 - RNA, 4062 nt, Artificial Sequence
  derived and/or modified CDS sequence (opt11) from MERS-CoV__ALA50067__S
augauccacagcguguuccugcucauguuccuccucacccccaccgaguccuacguugacgugggcccggacagcgugaaguccgccugcaucgaggucgacauacagcagacguucuucgacaagaccuggccccgccccaucgacgugagcaaggcggacgggaucaucuacccccaaggccggaccuacuccaacaucaccaucacguaccagggccucuucccguaccagggcgaccacggggacauguauguguacagcgcgggccacgccaccggcaccacgccccagaagcuguucgucgccaacuacucccaggacgugaagcaguucgccaacggguucgugguccgcaucggcgccgcugccaacagcaccggcaccgugaucaucucccccagcaccagcgccaccauccggaagaucuaccccgccuucaugcugggcucguccguggggaacuucagcgacgguaagaugggccgcuucuucaaccacacgcucguccugcugccggacgguugcggcacccuccugcgggcguucuauugcauccuggagccccgcuccgggaaccacugccccgccgggaacagcuacaccuccuucgccaccuaucacacgcccgcuaccgacugcagcgacgguaacuacaaccggaacgccucacucaacagcuucaaggaguacuucaaccugcgcaacugcaccuucauguacaccuacaacaucacggaagacgaaauccuggagugguuugggaucacccagaccgcccaaggcgugcaccucuucagcucccgguacguggaccuguacggugggaacauguuucaguucgccacccugccagucuacgacacgaucaaguacuacagcaucaucccccacuccauccgcagcauccaauccgacagaaaggccugggccgccuucuacguguacaaacuccagccccugaccuuccugcucgacuucucaguagauggguacauccgccgggcgaucgauugcgguuucaacgaccugucccagcugcacugcagcuacgagucguucgacgucgagagcggcguguacuccgugagcuccuucgaggccaagcccagcggauccgugguggagcaggccgagggcguggagugcgacuucagcccucuccuguccgggaccccgccucaagucuacaauuucaagcgccugguguucaccaacugcaacuacaacuugacgaagcugcugagccucuucucagugaacgacuucacgugcagccagaucagccccgccgcaaucgcgucuaauugcuacagcucccugauccuggacuacuuuagcuacccccucuccaugaaaagcgaccugagugugagcagcagcgggcccaucucgcaauucaacuacaagcagagcuucuccaacccgaccugccugauccucgccaccgugccucacaaccugacgaccaucaccaagccccugaaguacagcuacaucaacaagugcagccggcuccugagcgacgaccgcaccgaggugccccagcuggugaacgccaaccaguacucgcccugcgugagcaucguccccagcacggugugggaggacggggacuauuaccggaagcagcucuccccgcuggagggcggcggguggcugguggccagcggauccacggucgccaugaccgagcagcuccagaugggcuucggcaucaccgugcaauacgggaccgacacgaacagcgugugccccaagcuggaguucgcgaacgacacaaagaucgccucucagcugggcaacugcgucgaauacagccucuacggcguguccgggcgcggcguguuccagaacugcaccgcggucggggugcgucagcaacgcuucguguacgaugccuaccagaaccuggucggcuacuacagcgacgacgggaacuacuacugccugcgggcgugcguguccgugcccgucagcgugaucuacgauaaggagaccaagacccacgccacccuguucggaucaguagccugcgagcacaucagcuccaccaugagccaguacucccgcaguacccgcuccaugcugaagcggcgcgacagcacguacggcccgcugcagacccccgucggguguguccucggccucguaaacuccagccuguucgucgaggacugcaagcugccccucgggcagagccugugcgcccugcccgacaccccuuccacccucacgccccguagugugcgcuccgugcccggcgagaugcggcuggcaagcaucgcguucaaccaccccauccaaguugaccagcugaacuccagcuacuucaagcucucgaucccgaccaacuucagcuucggcgugacccaggaguacauacagacuacgauccagaaggugaccguggacugcaagcaguacgugugcaacggguuccaaaagugugagcagcugcuccgcgaguacggccaauucugcagcaagaucaaccaggcgcuccacggggccaaccugcggcaagacgacagcgugcgcaaccuguucgccuccgucaagagcucccaaagcucccccaucauccccggcuucgggggagacuucaaccugaccuugcuggagccagugagcaucuccaccggcagccgguccgcccgcuccgcgaucgaagaccuccuguucgacaaggugacgaucgccgacccgggguacaugcagggcuacgacgacugcaugcagcagggccccgccagcgcccgggacuuaaucugcgcccaguacgucgcaggcuacaagguguuaccgccccugauggacgugaacauggaggccgccuacaccuccagccugcucggguccaucgcuggagucggcuggaccgcggggcugagcuccuuugccgccauccccuucgcccaaagcaucuuuuaccgccugaacggcguggggaucacccagcagguccucuccgagaaccagaagcugaucgccaacaaguucaaccaggcgcugggcgccaugcagacgggguucaccaccaccaacgaggccuuccggaagguacaggacgccguaaacaacaacgcccaggcgcucagcaagcuggccuccgagcugagcaacacguucggcgccaucuccgccagcaucggcgacauaauccagcgccucgacgugcuggaacaggacgcccagauagaccgucugaucaacgggcgccucaccacccugaacgcguucgucgcccagcagcuggugcggagcgagagcgccgcccucuccgcgcagcuggccaaggacaaggugaacgagugcgucaaggcccagagcaagcgcuccggcuucugcgggcagggcacccacaucgugagcuucgucgugaacgcccccaacgggcuguacuucaugcacgucggguacuaccccuccaaccacaucgaggucgugagcgccuacggccuaugcgacgcggccaaccccacaaacuguaucgcuccggugaacggguacuucaucaagaccaacaacacucggaucgucgacgaguggagcuacaccggcuccagcuucuacgccccggaacccaucacgucccugaacaccaaguacguggcgccccaggugaccuaccagaacaucaguaccaaccugccuccgccacuccuguccaacagcaccgggaucgacuuccaggacgaacuggacgaguucuucaagaacgucuccacgagcauccccaacuucggcucccucacccagaucaacaccacccugcuggaccucacguacgaaaugcuaagccuacagcaggucguuaaggcccucaacgagucauacaucgaccugaaggagcucggcaacuacaccuacuacaacaaguggcccugguacaucuggcucggguucauagccggcuuaguggcccuggcccucugcguguucuucauccugugcugcaccggauguggcaccaacugcauggggaaacuuaagugcaaccgaugcugcgaccgcuacgaggaguacgaccucgagccccacaaggugcacguccacuga

SEQ ID NO: 1318 - RNA, 249 nt, Artificial Sequence
  derived and/or modified CDS sequence (opt11) from MERS-CoV__AGH58723__E
augcuccccuucguccaagaacgcaucggccucuucaucgucaacuucuucaucuucaccgucgucugcgccaucacccuccucgucugcauggccuuccucaccgccacccgccucugcguccaaugcaugaccggcuucaacacccuacucguccaacccgcccucuaccucuacaacaccggccgcuccgucuacgucaaauuccaagacuccaaacccccccucccccccgacgaaugggucuaa

SEQ ID NO: 1319 - RNA, 249 nt, Artificial Sequence
  derived and/or modified CDS sequence (opt11) from MERS-CoV__AGV08472__E
augcuccccuucguccaagaacgcgucggccucuucaucgucaacuucuucaucuucaccgucgucugcgccaucacccuccucgucugcauggccuuccucaccgccacccgccucugcguccaaugcaugaccggcuucaacacccuccucguccaacccgcccucuaccucuacaacaccggccgcuccgucuacgucaaauuccaagacuccaaacccccccucccccccgacgaaugggucuaa

SEQ ID NO: 1320 - RNA, 249 nt, Artificial Sequence
  derived and/or modified CDS sequence (opt11) from MERS-CoV__AGV08540__E
augcuccccuucguccaagaacgcaucggccucuucaucgucaaauucuucaucuucaccgucgucugcgccaucacccuccucgucugcauggccuuccucaccgccacccgccucugcguccaaugcaugaccggcuucaacacccuccucguccaacccgcccucuaccucuacaacaccggccgcuccgucuacgucaaauuccaagacuccaaacccccccucccccccgacgaaugggucuaa

SEQ ID NO: 1321 - RNA, 249 nt, Artificial Sequence
  derived and/or modified CDS sequence (opt11) from MERS-CoV__ALX27237__E
augcuccccuucguccaagaacgcaucggccucuucaucgucaacuucuucaucuucaccgucgucugcgccaucacccuccucgucugcauggccuuccucaccgccacccgccucugcguccaaugcaugaccggcuucaacacccuccucguccaacccgcccucuaccucuacaacaccggccgcuccgucuacgucaaauuccaagacuccaaacccccccuccccuccgacgaaugggucuaa

SEQ ID NO: 1322 - RNA, 249 nt, Artificial Sequence
  derived and/or modified CDS sequence (opt11) from MERS-CoV__ALR69646__E
augcuccccuucguccaagaacgcaucggccucuucaucgucaacuucuucaucuucaccgucgucugcgccaucacccuccucgucugcauggccuuccucaccgccacccgccucugcguccaaugcaucaccggcuucaacacccuccucguccaacccgcccucuaccucuacaacaccggccgcuccgucuacgucaaauuccaagacuccaaacccccccucccccccgacgaaugggucuaa

SEQ ID NO: 1323 - RNA, 249 nt, Artificial Sequence
  derived and/or modified CDS sequence (opt11) from MERS-CoV__ALA49346__E
augcuccccuucguccaagaacgcaucggccucuucaucgucaacuucuccaucuucaccgucgucugcgccaucacccuccucgucugcauggccuuccucaccgccacccgccucugcguccaaugcaugaccggcuucaacacccuccucguccaacccgcccucuaccucuacaacaccggccgcuccgucuacgucaaauuccaagacuccaaacccccccucccccccgacgaaugggucuaa

SEQ ID NO: 1324 - RNA, 249 nt, Artificial Sequence
  derived and/or modified CDS sequence (opt11) from MERS-CoV__ALA49390__E
augcuccccuucguccaagaacgcaucggccucuucaucgucaacuucuucaucuucaccgucgucugcgccaucacccuccucgucugcauggccuuccucaccgccacccgccucugcguccaaugcaugaccggccucaacacccuccucguccaacccgcccucuaccucuacaacaccggccgcuccgucuacgucaaauuccaagacuccaaacccccccucccccccgacgaaugggucuaa

SEQ ID NO: 1325 - RNA, 660 nt, Artificial Sequence
  derived and/or modified CDS sequence (opt11) from MERS-CoV__AFS88942__M
auguccaacaugacccaacucaccgaagcccaaaucaucgccaucaucaaagacuggaacuucgccuggucccucaucuuccuccucaucacaaucguccuccaauacggcuaccccucccgauccaugaccgucuacgucuucaaaauguucguccuauggcuacucuggccuuccuccauggcacuauccaucuucuccgccgucuaccccaucgaccucgccucccaaaucaucuccggcaucguagccgccgucucagccaugauguggaucuccuacuucguccaauccauccgccuauucaugcgcaccggcuccuggugguccuucaaccccgaaaccaacugccuccucaacgucccauucggaggcaccacagucguccgcccccucgucgaagacagcaccuccgucaccgccgucgucaccaacggccaccucaaaauggccggcaugcacuucggcgccugcgacuacgaccgucuccccaacgaagucaccgucgccaaacccaacguccucaucgcccucaaaauggucaaacgccaaucuuacggcaccaacuccggcgucgccauauaccaccguuacaaagccggcaacuaccgcucacccccaaucaccgccgacaucgaacucgcccuccuccgcgccuaa

SEQ ID NO: 1326 - RNA, 660 nt, Artificial Sequence
  derived and/or modified CDS sequence (opt11) from MERS-CoV__AGH58718__M
auguccaacaugacucaacucaccgaagcccaaaucaucgccgucaucaaagacuggaacuucgccuggucccucaucuuccuccucaucacuauaguacuucaauacggcuaccccuccagauccaugaccgucuacgucuucaaaauguucguccucuggcuccucuggcccuccucaauggcccucuccaucuucucaaccgucuaccccauagaccucgccucccaaaucaucuccggaaucgucgccgccgucucagccaugauguggaucuccuacuuuguccagucuauacgccucuucaugcgcaccggcuccuggugguccuucaaccccgaaaccaacugccuccucaacguacccuucggcggaaccacagucguccgcccccucguagaagacuccaccuccgucaccgccgucgucaccaacggacaccucaaaauggccggaaugcacuucggcgccugcgacuacgaccgccuccccaacgaagucaccgucgccaaacccaacguccucaucgcacucaaaauggucaaacgccaauccuacggcaccaacucaggcgucgccauauaccaccgcuacaaagccggcaacuaccgaucacccccaaucaccgccgacaucgaacucgcccuccuccgagcuuaa

SEQ ID NO: 1327 - RNA, 660 nt, Artificial Sequence
  derived and/or modified CDS sequence (opt11) from MERS-CoV__AGV08396__M
auguccaacaugacccaacucaccgaagcccaaaucaucgccaucaucaaagacuggaacuuugccuggagccucaucuuccuccuaaucaccaucguccuccaauacggcuaccccagccgcuccaugacagucuacguauucaaaauguucguccuaugguuacucuggcccuccuccauggcccucuccaucuucuccgccaucuaccccaucgaccucgccucccaaaucauauccggcauagucgccgccgucuccgccaugauguggaucucauacuucguccaauccauccgccuauucaugcgcaccggcuccuggugguccuucaaccccgaaaccaacugccuccuaaacguccccuucggcggcaccacagucguccgcccacucguagaagacuccaccuccgucaccgcagucgugaccaacggccaccucaaaauggccggcaugcacuucggcgccugcgacuacgaccgccuccccaacgaagucaccgucgccaaacccaacguccucaucgcccucaaaauggucaaacgccaaucauacggcaccaacagcggagucgccaucuaccaccgauacaaagccggcaacuaccgcucacccccaaucacagccgacaucgaacucgcccuccuucgcgccuaa

SEQ ID NO: 1328 - RNA, 660 nt, Artificial Sequence
  derived and/or modified CDS sequence (opt11) from MERS-CoV__AGV08590__M
auguccaacaugacccaacucaccgaagcccaaaucaucgccaucaucaaagacuggaacuucgucuggucccuuaucuuccuccuaaucaccaucguccuccaauacggcuaccccucccgcuccaugaccgucuacguauucaaaauguucguccucuggcuccucuggcccuccagcauggcccucuccaucuucuccgccgucuaccccaucgaccucgccucacaaaucaucuccggaaucguagccgcaguauccgccaugauguggaucuccuacuucguccaaucaauccgccuauucaugcgcaccggcuccugguggucauucaaccccgaaaccaacugccuacucaacguccccuucggcggcaccaccgucguccgcccccucgucgaagacuccaccuccgucaccgccgucgucaccaacggccaccucaaaauggcaggcaugcacuucggcgcaugcgacuacgaccgccuacccaacgaagucaccgucgccaaacccaacguccucaucgcccucaaaauggucaaacgacaauccuacggcaccaacucaggcgucgccaucuaccaccgcuacaaagccggcaacuaccgcuccccccccaucaccgccgacaucgaacuagcacuccuccgcgccuaa

SEQ ID NO: 1329 - RNA, 660 nt, Artificial Sequence
  derived and/or modified CDS sequence (opt11) from MERS-CoV__AHI48567__M
auguccaacaugacccaacucgcagaagcccaaaucaucgccaucaucaaagacuggaacuucgccuggucccucaucuuccuccucaucaccaucguccuccaauacggauaccccucacgcuccaugaccgucuacguauucaaaauguucguccucuggcuccucuggcccucauccauggcccucuccauauuuuccgccgucuacccaaucgaccucgccucccaaaucauaucaggcaucgucgccgccguauccgccaugauguggaucuccuacuucguccaauccauucgccucuucaugcgcaccggcuccuggugguccuucaaccccgaaaccaacugccuccucaacguccccuucggcggcaccaccguaguccgcccccucgucgaagacuccaccuccgucaccgccguagucaccaacggccaccucaaaauggccggcaugcacuucggcgccugcgacuacgaccgccuacccaacgaagucaccguagccaaacccaacguccucaucgcccucaaaaugguaaaacgccaaucauacggcacaaacuccggcgucgccaucuaccaccgcuacaaagcaggaaacuaccgcucacccccuaucaccgccgacaucgaacuagcucuccuccgagccuaa

SEQ ID NO: 1330 - RNA, 660 nt, Artificial Sequence
  derived and/or modified CDS sequence (opt11) from MERS-CoV__AHI48589__M
auguccaacaugacccaacuaacagaagcccaaaucaucgccgucaucaaagacuggaacuucgccuggucccucaucuuccuacuaaucaccaucguacuccaauacggcuaccccucccgcucaaugacagucuacguauucaaaauguucguccuuuggcuccucuggcccuccucuauggcacucuccaucuucuccgcaaucuaccccaucgaccucgccucccaaaucaucuccggcaucgucgccgccgucucagccaugauguggaucucauacuucguccaauccauccgccucuucaugcgcaccggcucauggugguccuuuaaccccgaaaccaacugccuccuaaacguccccuucggcggcaccaccgucguccgcccacucgucgaagacucaaccuccgucaccgccgucguaaccaacggccaccucaaaauggccggcaugcacuucggagccugcgacuacgaccgccuccccaacgaagucaccgucgccaaaccuaacguccucaucgcccucaaaauggucaaacgacaauccuacggcaccaacuccggcgucgccaucuaccaccgauacaaagccggcaacuaccgcucacccccaaucacagccgacaucgaacucgcccuccuccgcgccuaa

SEQ ID NO: 1331 - RNA, 660 nt, Artificial Sequence
  derived and/or modified CDS sequence (opt11) from MERS-CoV__AIL23940__M
auguccaacaugacucaacucaccgaagcccaaaucaucgccaucaucaaagacuggaacuucgccuggucucucaucuuccuccucaucaccaucguccuccaauacggcuaccccucacgcuccaugacagucuacguauucaaaauguucguccucuggcuccucuggcccucauccauggcccucuccauauucucugccaucuaccccaucgaccucgccucccaaaucaucuccggcaucgucgccgccgucuccgccaugauguggaucuccuacuucguccaauccauacgccucuucaugcgcaccggcuccuggugguccuucaaccccgaaaccaacugccuccuaaacguccccuucggcggcaccaccgucguccgcccacucgucgaagacuccaccuccgucaccgccgucgucaccaacggacaccucaaaauggccggcaugcacuucggcgccugcgacuacgaccgccucccaaacgaagucaccgucgccaaacccaacgucguaaucgcccucaaaauggucaaacgacaaucuuacggcaccaacuccggcgucgccaucuaccaccgcuacaaagccggcaacuaccgcucgccucccaucaccgcagacaucgaacucgcucuccuccgcgccuaa

SEQ ID NO: 1332 - RNA, 660 nt, Artificial Sequence
  derived and/or modified CDS sequence (opt11) from MERS-CoV__AKM76245__M
auguccaacaucacccaacuuaccgaagcccaaaucaucgccaucaucaaagacuggaacuucgccuggucccucaucuuccuccucaucaccaucguccuacaauacggcuaccccucccgcuccaugaccgucuacgucuucaaaauguucguccucuggcuacucuggcccuccuccauggcccucuccaucuucuccgccgucuaccccaucgaccucgccucccaaaucaucuccggcaucgucgccgccgucuccgccaugauguggaucucauacuucguacaauccauacgccucuucaugcgcacaggcuccuggugguccuucaaccccgaaaccaacugccuccuuaacguccccuucggcggcaccaccgucguccgcccccucgucgaagacuccaccuccguaaccgccgucgucaccaacggccaccucaaaauggccggcaugcacuucggcgccugcgacuacgaccgccuccccaacgaagucaccgucgccaaacccaacguccucaucgcccucaaaauggucaaacgccaauccuacggcacaaacuccggcgucgccaucuaccaccguuacaaagccggaaacuaccgcucacccccaaucaccgccgacaucgaacucgcccuacuccgcgccuaa

SEQ ID NO: 1333 - RNA, 660 nt, Artificial Sequence
  derived and/or modified CDS sequence (opt11) from MERS-CoV__ALW82726__M
auguccaacaugacccaacuuaccgaagcccaaaucaucgccaucaucaaagacuggcacuucgccuggucccucaucuuccuccucaucaccaucguccuacaauacggcuaccccucccgauccaugaccgucuacgucuucaaaauguucguccucuggcuccucuggcccuccuccauggcccucucaaucuucuccgccaucuaccccaucgaccucgccucacaaauaaucucuggcaucgucgccgccgucuccgccaugauguggaucucauacuucguccaauccauccgccucuucaugagaaccggcuccuggugguccuucaaccccgaaaccaacugccuccuaaacguccccaucggcggcaccaccgucguccgcccccucgucgaagacuccaccuccgucaccgccgucgucaccaacggccaccucaaaauggccggcaugcacuucggcgccugcgacuacgaccgccuacccaacgaagucaccgucgccaaacccaacguccucauagcacuaaaaauggucaaacgccaauccuacggcaccaacuccggcgucgccaucuaccaccgcuacaaagccggcaacuaccgauccccccccauaacagccgacaucgaacucgcccuccuccgcgccuaa

SEQ ID NO: 1334 - RNA, 660 nt, Artificial Sequence
  derived and/or modified CDS sequence (opt11) from MERS-CoV__ALX27238__M
auguccaacaugacccaacucaccgaagcccaaaucaucgccaucaucaaagacugguccuucgccuggucccucaucuuccuccucaucaccaucguccuccaauacggcuaccccucccgcuccaugaccgucuacgucuucaaaauguucguccuauggcuccucuggcccucauccauggcccucuccaucuucucugccgucuaccccaucgaccucgcuucccaaaucaucuccggcauaguagccgccgucucagccaugauguggaucucauacuucguccaauccauccgccuauucaugcgcaccggcucauggugguccuucaacccagaaacaaacugccuccucaacguccccuucggcggcaccaccgucguccgcccccucgucgaagacuccaccuccgucaccgccgucgucaccaacggccaccucaaaauggccggcaugcacuucggcgccugcgacuacgaccgccuacccaacgaagucaccgucgccaaacccaacguccuuauagcccucaaaauggucaaacgccaauccuacggcaccaacuccgguguagccauauaccaccgcuacaaagccggcaacuaucgcucaccacccaucacugccgacaucgaacucgcccuucuccgcgccuaa

SEQ ID NO: 1335 - RNA, 660 nt, Artificial Sequence
  derived and/or modified CDS sequence (opt11) from MERS-CoV__AMQ49021__M
auguccaacaugacccaacucaccgaagcccaaaucaucgccauuaucaaagacuggcacuucgccuggucccucauauuccuccucaucaccaucguccuccaauacggcuaccccucccgcuccaugaccgucuacgucuucaaaauguucguccucuggcuccucuggcccuccucaauggcccucuccaucuucucagccaucuaccccaucgaccuagccucccaaaucaucuccggcaucgucgccgccgucucagccaugauguggaucuccuacuucguccaauccauccgccucuucaugcgaaccggcuccuggugguccuucaaccccgaaaccaacugccuccucaacguacccaucggcggcaccaccgucguccgcccccuugucgaagacuccaccuccgucaccgccgucgucaccaacggccaccucaaaauggccggcaugcacuucggcgccugcgacuacgaccgccuauccaaugaaguaaccguagccaaacccaacguccucaucgcccucaaaauggucaaacgccaauccuacggcaccaacuccggcgucgcaaucuaccaccgauacaaagccggcaacuaccgcuccccgcccaucaccgccgauaucgaacucgcucuccuccgcgccuaa

SEQ ID NO: 1336 - RNA, 660 nt, Artificial Sequence
  derived and/or modified CDS sequence (opt11) from MERS-CoV__AJG44108__M
auguccaacaugacccaacuuaccgaagcacaaaucaucgccaucaucaaagacuggaacuucgccuggucccucaucuuccuccuuaucaccauaguccuccaauacggcuaccccucccgauccaugaccguauacgucuucaaaauguucguccuuuggcuccucuggcccuccuccauggcccucuccaucuucucugccuucuaccccaucgaccucgccucccaaaucaucuccggcaucgucgccgccgucuccgccaugauguggaucuccuacuucguccaauccauccgccucuucaugcgaaccggcucauggugguccuucaaccccgaaaccaacugccuccucaacguacccuucggcggcaccaccgucguccgcccccucgucgaagacuccaccuccgucaccgccgucgucaccaacggccaccucaaaauggcaggcaugcacuucggcgccugcgacuacgaccgccuccccaacgaaguaaccgucgccaaacccaacguccucaucgcccucaaaaugguuaaacgccaauccuacggcaccaacuccggcgucgccauauaccaccgcuacaaagcaggcaacuaccgcuccccccccaucaccgccgacaucgaacuagcccuccuccgcgccuaa

SEQ ID NO: 1337 - RNA, 660 nt, Artificial Sequence
  derived and/or modified CDS sequence (opt11) from MERS-CoV__ALA49369__M
auguccaacaugacccaacucaccgaagcccaaaucaucgccauaaucaaagacuggaacuucgccuggucccucaucuuccuccucaucaccaucguacuucaauacggcuaccccucccgcuccaugaccgucuacgucuucaaaauguucguccucuggcuccuauggcccuccuccauggcccucuccaucuucucagccaucuaccccaucgaccucgccucccaaaucaucuccggaaucgucgccgcagucucagccaugauguggaucuccuacuucguccaauccauccgccucuucaugcgcaccggcuccuggugguccuucaaccccgaaacaaacugccuacucaacguccccauaggcggcaccacaguaguccguccccucgucgaagacuccaccucagucaccgccgucguaaccaacggccaccucaaaauggccggcaugcacuucggcgccugcgacuacgaccgccuccccaacgaaguaaccgucgccaaacccaacguccucaucgcccucaaaauggucaaacgacaauccuacggcaccaacuccggcgucgcaaucuaccaucgauacaaagccggaaacuaucgcuccccccccaucacagccgacaucgaacuagcccuccuccgcgccuaa

SEQ ID NO: 1338 - RNA, 660 nt, Artificial Sequence
  derived and/or modified CDS sequence (opt11) from MERS-CoV__ALA49424__M
auguccaacaugacccaacucaccgaagcccaaaucaucgcaaucaucaaagacuggaacuucgccuggucccucaucuuccuccucaucaccaucguccuccaauacggcuaccccucacgcuccaugaccgucuacgucuucaaaauguucguccucuggcuccucuggcccuccuccauggcacucuccaucuucuccgccauauaccccaucgaccucgccucccaaaucaucuccggaaucgucgccgccgucuccgccaugaugcgaaucuccuacuucguccaaucaauacgacucuucaugcgaaccggcuccuggugguccuucaaccccgaaaccaacugccuccuaaacguacccuucggcgguaccaccgucguccgcccccucguagaagacuccaccuccgucaccgccgucgucaccaacggccaccucaaaauggcuggcaugcacuucggcgcaugcgacuacgaccgccuacccaacgaagucaccgucgccaaacccaacguccucaucgcccucaaaauggucaaacgacaauccuacggcaccaacuccggcgucgccaucuaccaccgauacaaagccggcaacuaucguuccccccccaucaccgccgacaucgaacucgcccuccuccgagccuaa

SEQ ID NO: 1339 - RNA, 660 nt, Artificial Sequence
  derived and/or modified CDS sequence (opt11) from MERS-CoV__ALA49908__M
auguccaacaugacccaacuaaccgaagcccaaaucaucgccaucaucaaagacuggaacuucgccuggucccucaucuuccuccuaaucaccaucguacuccaauacggcuaccccucccgcuccaugaccgucuacgucuucaaaauguucguccucuggcuacucuggcccuccucaauggcccucuccaucuucuccgccaucuaccccaucgaccucuccucccaaaucaucucuggcaucgucgccgccgucuccgccaugauguggaucuccuacuucguccaauccauccgccucuucaugcgcaccggcuccuggugguccuucaaccccgaaaccaacugccuccuuaacguccccuucggcggcaccaccgucguacgcccccucgucgaagacuccacauccgucaccgccgucgucaccaacggccaccucaaaauggcaggcaugcacuucggcgccugcgacuacgaccgacuucccaacgaagucaccgucgccaaacccaacguccucaucgcccucaaaauggucaaacgccaauccuacggcaccaacuccggcgucgccaucuaccaccgcuacaaagcuggcaacuaccgcuccccccccaucaccgccgacaucgaacucgcccuacuacgcgccuaa

SEQ ID NO: 1340 - RNA, 660 nt, Artificial Sequence
  derived and/or modified CDS sequence (opt11) from MERS-CoV__ALA49963__M
auguccaacaugacacaacucaccgaagcccaaauaaucgccaucaucaaagacuggaacuucgccuggucccucaucuuccuccucaucaccaucguacuacaauacggcuaccccucucgcuccaugaccgucuacgucuucaaaauguucguucucuggcuccucuggcccuccucuauggcacucucaaucuucuccgccauauaccccaucgaccucgccucccaaaucaucuccggcaucgucgccgccgucuccgccaugauguggaucucauacuucguccaauccauccgccucuucaugcgcaccggcuccuggugguccuucaaccccgaaaccaacugccuccuaaacguccccaucggcggcaccaccgucguccgcccccucgucgaagacuccaccuccgucacagccgucgucaccaauggccaccucaaaauggccggcaugcacuucggagccugcgacuacgaccgacucuccaacgaagucaccgucgcaaaacccaacguccucaucgcccucaaaauggucaaacgccaauccuacggcaccaacuccggcgucgccaucuaccaccgcuacaaagccggcaacuaccgcucaccacccaucacagccgacaucgaacucgcccuacuccgcgccuaa

SEQ ID NO: 1341 - RNA, 1242 nt, Artificial Sequence
  derived and/or modified CDS sequence (opt11) from MERS-CoV__AFS88943__N
auggccucacccgccgccccgcgcgccgucucauucgcagacaacaacgacaucacaaacaccaaccugagccgcggccgaggcagaaaccccaaaccacgagcggcaccaaacaacaccguaagcugguacaccggccugacccaacacgggaaagucccccugaccuucccaccgggccaaggcgucccccuaaacgcaaacuccacaccagcucaaaacgcgggcuacuggagacgccaagacaggaaaauaaacaccggaaacggcaucaaacaacucgcaccccgaugguacuucuacuacacgggcaccggccccgaagccgcccuccccuuucgagccguaaaagacggcaucguguggguacacgaagacggagccacagacgcccccucaaccuucggcacacgaaaccccaacaacgacuccgcaaucgucacacaauucgcaccagggacaaaacuccccaaaaacuuccacauagaaggaaccggcggcaacucccaaucaagcagccgcgccagcucccuaucccgcaacuccucccgcuccagcucacagggaucccgaaguggaaacuccacacgaggcacaucccccggcccauccggaaucggagccguaggcggcgaccugcuauaccucgaccuccuaaaccgacuacaagcccuagaaucgggcaagguaaaacaaucacaacccaaaguuaucacaaagaaagacgcagcagccgccaaaaacaaaaugagacacaaacgaaccuccaccaaaucuuucaacaugguccaagcauucggccuccggggccccggcgaccuccaaggcaacuucggggaccuccaacucaacaaacuaggaaccgaagacccccgcuggccccaaauagccgaacuagcccccaccgcaagcgcauucaugggcaugucccaauucaaacucacacaccaaaacaaugacgaccacggcaaccccgucuacuuccuccgcuacagcggagccaucaaauuagaccccaaaaacccaaacuacaacaaauggcucgaacuccuagaacaaaacaucgacgccuacaagacauucccaaagaaagaaaagaaacaaaaagccccaaaagaagaauccaccgaccaaauguccgagcccccaaaagaacaacgaguccaaggcucaauaacucaacgaacccgaacacgccccucaguccaacccgggccaaugaucgacguaaacaccgacuga

SEQ ID NO: 1342 - RNA, 1236 nt, Artificial Sequence
  derived and/or modified CDS sequence (opt11) from MERS-CoV__AFY13314__N
auggcaucccccgccgccccacgcgccgucagcuucgcagacaacaacgacaucacaaacacgaaccuauccagaggcagaggccgcaaccccaaaccccgcgcagcccccaacaacacaguauccugguacacaggccucacccaacacgguaaagucccacucaccuuuccccccggacaaggagucccccucaacgccaacuccacaccagcccaaaaugccggcuacuggcgccgccaggaccgaaaaauaaacacaggcaauggcauaaaacaacucgcgccccgaugguacuucuacuacacaggcaccggcccggaagcagcccugccguuccgcgccgucaaagacggcaucguguggguccacgaagacggagccaccgacgcacccuccaccuucggcacgcgcaaccccaacaacgacuccgccaucguaacacaauucgccccaggaacaaagcuccccaaaaacuuccauaucgaaggcacaggcggcaacucccaauccuccuccagagccuccucagucagccgcaacagcucccgcucauccagccaaggaagccgcagcggcaacucaacacgaggcacauccccaggcccauccggaaucggagccgucggcggcgaccuucucuaccucgaccuacucaaccgccuccaagcccucgaaucaggcaaaguaaaacaaucccagccgaaaguaaucaccaaaaaagacgccgccgcagcaaaaaacaaaaugcgacacaaacgaaccagcaccaaauccuucaacaugguacaggccuucggccuccggggccccggugaccuacaaggaaacuucggagacuuacaacuaaacaaacucggcaccgaagacccccgauggccccaaauagcggaacuagcccccacugcaagcgcauucaugggaaugagccaauucaaacucacacaccaaaacaacgaugaccauggaaacccagucuacuuccuacgcuacuccggcgccaucaaacuugaccccaaaaacccaaacuacaacaaauggcucgaacuccuagaacaaaacaucgacgcguacaaaaccuuccccaaaaaagaaaaaaaacaaaaagcccccaaagaagaaucaacagaccaaaugagcgaacccccgaaagaacacagaguccaaggcacacaacgcacccgcacccgccccucgguccaacccggccccaugaucgaugucaacaccgacuga

SEQ ID NO: 1343 - RNA, 1242 nt, Artificial Sequence
  derived and/or modified CDS sequence (opt11) from MERS-CoV__AGH58724__N
auggccucgcccgcagcuccacgcgccgucuccuucgcuuacaacaacgacaucaccaacaccaaccucucccgcggccgcggacgcaacccaaaaccaagagcagcccccaacaacaccgucuccugguacaccggccugacacaacacggcaaagucccccugaccuuucccccaggccaaggcgucccccucaacgcaaacuccaccccagcccagaacgccggcuauuggcgccgccaagaccgcaaaauaaacacaggcaacggaauaaaacaacucgcaccccgcugguacuucuacuacaccggaaccggacccgaagccgcacugcccuuccgcgcaguaaaagacggcaucgucuggguccacgaagacggcgccaccgacgcgcccagcaccuucggaacccgcaacccaaacaacgacuccgccauagucacccaauucgcucccggaacaaaacuccccaaaaacuuccacaucgaaggcaccggaggcaacucccaauccuccagccgcgccagcucugucucgagaaacuccucacgcucaucaucccaaggcucccgcagcggaaacuccacccgaggaacaagccccggcccauccgguaucggcgccguaggaggcgaccuacuauaccucgaccuccucaacagauuacaagcccuagaaucaggaaaagucaaacaaucccaacccaaagucaucacaaaaaaagacgcagccgccgccaaaaacaagaugcgacacaaacgcaccagcaccaaaaguuucaacaugguacaagcauucggacuccgcggacccggcgaccuccaaggaaacuucggcgaccuccaacuaaacaaacucggaaccgaagacccacgcuggccacaaauagccgaacucgccccaaccgcauccgccuucaugggcaugagccaauucaaacucacacaccaaaacaacgacgaccacggcaaccccgucuacuuccuccgcuacagcggcgccaucaaauuagacccaaaaaaccccaacuacaacaaauggcuagaacuacucgaacaaaacauagacgccuacaagaccuuccccaaaaaagaaaaaaaacaaaaagccccaaaagaagaaucaaccgaccaaauguccgaaccccccaaagaacagcgcguccaaggauccaucacacaacgaacccgaacccgccccuccguucaaccaggcccaaugauagacgucaacacagacuaa

SEQ ID NO: 1344 - RNA, 1242 nt, Artificial Sequence
  derived and/or modified CDS sequence (opt11) from MERS-CoV__AGV08397__N
auggccucccccgcagcuccccgcgccgucuccuucgccgacaacaacgacaucaccaacacaaaccuaucccgaggccgaggccgaaaccccaaaccccgcgcagccccuaacaacacagucuccugguacaccggccugacccaacacggaaaagucccacucaccuucccacccggccaaggcgucccccugaacgcaaacuccacacccgcacaaaacgccggcuacuggcgccgacaagaccgaaaaauaaacacaggcaauggcaucaaacaacuagcaccccgcugguacuucuacuacaccgggacaggccccgaagccgcccuaccauuccgcgccguaaaagauggcauagucuggguacacgaagacggggccacagaugcacccucaaccuucggaacccgaaacccaaacaacgacucugcaaucguaacccaauucgcccccggcaccaaacuacccaaaaacuuccacaucgaaggcaccggaggaaacucccaauccucaucccgcgcuucuuccgucucccgcaauucauccagauccagcucacaaggcucccgaucaggaaacucaacccgcggcaccucccccggaccaucaggcaucggagccguaggcggagaccuacuauaucucgaccuccucaaccgacuacaagcccuggaauccggcaaaguuaaacaaucacaaccaaaagucaucaccaagaaagacgccgccgcagccaaaaacaaaaugcgccacaaacgcaccuccacaaaauccuucaacaugguccaggcauucggccuccgcggccccggcgaccuccaaggaaacuucggcgaccuccaacucaauaaacuuggcaccgaagacccaagauggccccaaaucgccgaacuugcacccacagccucggccuucaugggcaugucccaauucaaacucacucaccaaaacaacgacgaucacggcaaccccguauacuuccuccgauacuccggagccaucaaacuagaccccaaaaaucccaacuacaacaaauggcuugaacuccucgaacaaaacaucgacgcuuacaaaacuuuccccaagaaagaaaagaaacaaaaagcacccaaagaagaacuaaccgaccaaauguccgaaccacccaaagaacaacgcguacaaggcucaaucacccaacguacccgcaccagacccuccguccaacccggacccaugauugacgucaacaccgacuaa

SEQ ID NO: 1345 - RNA, 1242 nt, Artificial Sequence
  derived and/or modified CDS sequence (opt11) from MERS-CoV__AGV08415__N
auggcuucccccgccgccccaagagcaguuuccuucgcagacaacaacgacauuaccaacaccaaucucuccagaggaagaggcagaaaccccaaaccccgugccgcccccaacaacaccgucucaugguacacaggacucacccaacacggcaaaguaccccucaccuucccacccggacaaggcgucccccucaacgccaacuccacaccagcccaaaacgcaggauacuggcgccgccaagaccgaaaaaucaacacaggcaacggcaucaaacaacucgcaccccgcugguacuucuacuacaccggcaccggacccgaagcugcacuucccuuccgagccgucaaagacggcaucguauggguccacgaagacggcgcaaccgacgcccccuccaccuucggaacccguaaccccaacaaugacucugcaauagucacacaauucgccccaggcaccaaacuccccaaaaacuuccacaucgagggcaccggcggcaacucccaauccucaucccgcgcauccuccguaucccguaacagcucccgcucauccucacaaggcucaagauccggaaacuccacccgcggcaccucgcccggccccagcggaaucggcgccguaggcggagaccuacuuuaccucgaccuccucaaccgucuccaagcccuagaauccggcaaagucaaacaaucccaacccaaaguuauaaccaagaaagacgccgccgcagccaaaaacaaaaugcgucacaaacgcaccuccacaaaaucauucaauaugguccaagcauucggacuccgcggacccggcgaccuccaaggaaacuucggggaccuccaacuaaacaaacucggcacugaagacccacgcuggccccaaauagcagaacuagccccaaccgcaucagcauucaugggcaugucacaauucaaacugacucaccaaaacaacgacgaucacggcaaccccgucuacuuccuccgcuacagcggcgccaucaaacucgaccccaaaaaccccaacuacaacaaauggcuagaacuccucgaacaaaacauagacgccuacaaaaccuuccccaagaaagaaaagaaacaaaaagcaccaaaagaagaauccaccgaccaaaugagcgaaccacccaaagaacaacgcguccagggcuccaucacccaacguacccgcacacgccccucaguccagcccggccccaugaucgacgucaacacagacuaa

SEQ ID NO: 1346 - RNA, 1242 nt, Artificial Sequence
  derived and/or modified CDS sequence (opt11) from MERS-CoV__AGV08487__N
auggcaagccccgcagccccccgcgcuguauccuucgccgacaacaacgacauaacaaacaccaaccuaucccgaggaaggggccgaaaccccaaaccccgagcagccccaaacaacaccguguccugguacacaggccuaacccaacacggcaaagucccacuuacauucccccccggccaaggcguaccccuaaacgccaacagcacacccgcacaaaacgccggauacuggcgacgacaagaccgaaaaauaaacaccgguaacggcauuaaacaacucgccccccgcugguacuucuauuacaccggaacaggacccgaagccgcccuccccuucagagccguaaaagauggaaucgucuggguccacgaacacggugccacagacgcacccucuacauucggcacccgaaaccccaacaacgacuccgcaauaguaacccaauucgccccaggcacaaaacuccccaaaaacuuccacaucgaaggcaccggcggaaacucccaaagcuccagcagagccuccuccgucucccgcaacagcucccgcucauccucccaaggcucccgcuccgguaacagcacccgcgguaccucccccggacccagcggcaucggugccgugggcggcgaccuccucuaccucgaccuccucaaccgccuacaagcccuugaaucaggaaaagucaagcaaucccaaccaaaaguaaucacaaaaaaagacgccgcagccgccaaaaacaaaaugcgccacaaaagaaccaguacaaaauccuucaacaugguacaagcauucggacucagaggccccggcgaccuccagggcaacuucggcgaccuacaacucaacaaacucggcaccgaagacccacguuggccccaaaucgcagaacucgcccccacugccagcgccuucaugggcaugucccaguucaaacuaacccaccagaacaacgacgaccacggcaaccccgucuacuuccuacgcuacuccggagccaucaaacuagaccccaaaaacccaaacuacaacaaauggcucgaacuucucgaacaaaacauagacgccuacaaaacauucccaaaaaaagaaaaaaaacaaaaagcacccaaagaagaaucaaccgaccaaaugucagaaccacccaaagaacaacgaguccaaggaucaaucacccaacgaacccgcacacgaccauccguucaacccggaccaaugaucgacgucaacaccgacuaa

SEQ ID NO: 1347 - RNA, 1242 nt, Artificial Sequence
  derived and/or modified CDS sequence (opt11) from MERS-CoV__AHC74095__N
auggccucccccgcagcaccccgcgccgucuccuucgccgacaacaacgacauaaccaauacuaaccuaagcaggggcagaggacgcaaccccaaaccacgcgccgcccccaacaacaccguuagcugguacaccggccucacccaacacggcaaaguaccccuaaccuuucccccgggucaaggcgucccacucaacgccaacucgacacccgcacaaaacgcaggauacuggcgccgccaagacaggaaaaucaacaccggcaacgguaucaaacaacucgcaccacgcugguacuucuacuacaccggcaccggcccagaggccgcccuccccuuccgcgccgucaaagacggaauaguauggguccacgaagacggagcuaccgacgcaccaucuacauucggcacccgcaacccaaacaacgaccucgccaucguaacccaauucgcccccgggaccaaacuccccaaaaauuuccacaucgaaggcaccggcggcaacucacaaucgagcucccgagccuccuccguaucacgcaacagcucccgcucauccagccaaggauccagauccggaaacucaacacgaggcacauccccaggccccuccggcauaggcgcagucggcggcgaccuacuauaccucgaccuccucaacagacuccaagcccucgaauccggaaaggucaaacaaucccagccgaaagucauaaccaagaaagacgccgcagcagccaaaaacaaaaugcgucacaaacgcacaucaacgaaaucauucaacaugguacaagcauucggccuccgcggccccggcgaccuccaaggcaacuucggcgaccuccaacuaaacaaacuaggcaccgaggacccucguuggccccaaaucgcggaacucgcacccaccgccucagcauucaugggaaugagccaauucaaacucacccaccaaaacaacgacgaccacggaaaucccguuuacuuucuacgcuacagcggagcaaucaaacucgaccccaaaaacccaaacuacaacaaauggcuugaacuccuagaacaaaacauagacgccuacaaaaccuuccccaagaaagaaaagaaacaaaaagccccuaaagaagaaucaaccgaccaaaugucagaacccccaaaagaacaacgaguccaaggcuccaucacacaacgcacacgcacccgacccucgguccaacccggacccaugaucgacgucaacaccgacuaa

SEQ ID NO: 1348 - RNA, 1242 nt, Artificial Sequence
  derived and/or modified CDS sequence (opt11) from MERS-CoV__AHI48535__N
auggcaucccccgcagcuccacgugcagucuccuucgcagacaacaacgauaucacaaacaccaaccucucccgaggccgcggccgaaaccccaaaccccgcgcagcacccaacaauacaguuagcugguacaccggccuaacacaacacggaaaagucccacuaaccuucucgcccggccaaggugucccccucaacgcgaacagcacacccgcacaaaacgccggcuacuggcgaagacaagaccgcaaaauuaacaccggaaauggaaucaaacagcuagcacccagaugguacuucuacuacacaggcacuggccccgaagccgcacuacccuuccgagcugucaaagacggcauaguauggguacacgaagacggagcaacggacgcacccuccaccuucggcacacgcaaccccaacaacgacuccgccauagugacccaauucgcucccgguacuaaacuccccaaaaacuuccacauagaaggcaccggcggcaacucccaaucauccucccgcgcauccuccgucucccgcaacuccucccguuccuccucccaaggaagucgauccggaaacuccacaagaggaaccagccccggaccaucaggcauaggcgccgucggcggcgaccuacucuaccuagaccuccucaaccgacuccaagcccucgaaucuggcaaagucaaacaaucccaacccaaagucaucaccaaaaaagacgcugccgccgccaaaaacaaaaugcgccacaagagaacaucaaccaaaucauucaacaugguccaagcauucggccuccgaggccccggcgaccuccaaggaaacuucggcgaccuacaacucaacaaacuaggcacagaggacccacgcuggccccaaaucgcagaacucgcccccaccgccuccgcauucaugggcaugagccaguucaaacucacacaccaaaacaacgacgaccacggaaaccccgucuauuuccuccgcuacagcggagcgaucaaacuagauccaaaaaacccaaacuacaacaaauggcucgaacuccucgaacaaaacaucgacgcauacaagaccuucccaaaaaaagagaaaaaacaaaaagcacccaaagaggaauccacugaccaagucagcgaaccccccaaagaacaacgaguccaaggcauaaucacccaacgaacccgcacccgccccuccguccaacccggacccaugaucgacgucaacaccgacuaa

SEQ ID NO: 1349 - RNA, 1242 nt, Artificial Sequence
  derived and/or modified CDS sequence (opt11) from MERS-CoV__AIL23941__N
auggcaucacuagccgccccccgagcagucuccuucgccgacaacaaugacaucacaaacacaaaccuaagccgaggccgcggccgaaaccccaaaccgcgcgcagccccaaacaacaccgucagcugguacacaggccucacccaacacggaaaagucccacuaaccuucccaccaggccaaggugucccccucaacgccaacagcaccccagcccaaaacgccggcuauuggcgccgccaggaccgcaaaauaaacacaggcaauggcaucaaacaacucgccccaagaugguacuucuacuacacaggcaccggcccagaagccgcacuccccuuccgagcaguaaaagacggcauagucuggguacacgaacacggcgcaacggaugcacccuccaccuucggcacccgcaaccccaacaacgacuccgccauagucacccaauucgcccccggaacgaaacuccccaaaaacuuccacaucgagggcacaggcggcaacucacaauccuccucccgcgccagcucagucucccgcaacuccucaagaucaucaucccaaggcagcagaagcggcaacucaacaagaggcaccagccccggcccaagcggcaucggggccguaggcggcgaccugcucuaccuugaccuacucaaccgacuccaggcauuggaaucaggcaaagucaaacaaucccaaccaaaaguaaucaccaaaaaagacgcagccgcggccaaaaacaagaugcgccacaaaagaaccucaacgaaaucauucaacaugguacaagccuucggccuuagaggccccggagaccuccaaggcaacuucggggaccuacaacucaacaaacuaggcaccgaagacccacgcuggccacaaaucgccgaacucgcccccacagcauccgcauucaugggcaugagccaauucaaacucacacaccaaaacaacgacgaccacggaaacccagucuacuuccuccgcuacuccggagccauaaaacuagacccaaaaaaccccaacuacaacaaauggcucgaacuccucgaacaaaacaucgacgcauacaaaacauucccaaaaaaagaaaaaaagcaaaaagcccccaaagaagaaucaaccgaccaaaugagcgaacccccaaaagaacaacgcguccaaggcucaaucacacaaaggacccgaacccgcccauccguccaacccggccccaugaucgacgucaacaccgacuag

SEQ ID NO: 1350 - RNA, 1242 nt, Artificial Sequence
  derived and/or modified CDS sequence (opt11) from MERS-CoV__AIL23996__N
auggccucaccagccgcaccucgagcagucuccuucgcagacaacaacgacaucaccaacacaaaccucagccggggccgaggacgcaaccccaaaccaagagccgccccaaacaacacagucuccugguacacgggccuaacccaacacggcaaaguccccuuaaccuucccaccaggacaaggcguuccccucaacgccaacucaaccccagcccaaaacgccgguuacuggagacgacaagaccgcaaaaucaacaccggaaacggcaucaaacaacuagccccccgcugguacuucuauuacaccggaacaggaccggaagcagcacuucccuuccgagccgucaaggacggaaucgucuggguccacgaagacggagccaccgacgcgcccucaaccuuuggcaccagaaacccaaacaacgaccucgccaucgucacccaauucgcgcccggcacaaaacucccaaaaaacuuccacaucgaaggaacaggcggcaacucccaaucauccucacgcgccuccucagucucacgcaacuccucacgcuccagcucacaaggcucccgcuccggcaacuccacuagaggaaccagcccaggccccuccggcaucggcgcugucggcggcgaccuccucuaccucgaccuccucaaccgccuccaagcccuggaauccggcaaagucaaacaaucccaacccaaagucaucaccaaaaaagacgccgcagccgccaaaaacaaaaugcgacacaaacgcacauccaccaaaucguucaacaugguacaagccuucggccuacgcggaccaggcgaccuccaaggcaacuucggcgaccuccaacucaacaagcuaggaacagaagacccccgcuggccccaaaucgcagaacuagcaccaacagccagcgccuucaugggcaugagccaauucaaacuaacccaccaaaacaacgacgaccacggaaaccccguguacuuccuacgcuacuccggagcaaucaaacuagacccaaaaaacccaaacuacaacaaauggcucgaacuacucgaacaaaacaucgacgcauacaaaaccuucccaaaaaaagaaaaaaaacaaaaagccccaaaagaagaauccacagaccaaaugagcgaacccccuaaagaacaacggguacagggcuccauaacacaacacacacgcacucgccccucaguacagccaggcccaaugauagacgucaacaccgacuaa

SEQ ID NO: 1351 - RNA, 1242 nt, Artificial Sequence
  derived and/or modified CDS sequence (opt11) from MERS-CoV__AIY60565__N
auggcagccccagcagcaccgagagccgucucauucgccgacaacaacgacauaaccaacaccaaccucucccgaggccgcggccgaaacccaaaaccucgagcagcacccaacaacaccguaucaugguacacaggccuaacccaacacggcaaagucccacuaacauucccccccggccaaggaguaccccuaaacgccaacuccacccccgcccaaaacgcagguuacuggagacgccaagacagaaaaauaaacaccgguaacggcauaaaacaacucgccccacgcugguacuucuacuacaccggaacaggcccggaagccgcccucccauuccgcgcagucaaagacggcaucgucuggguccacgaagacggcgccacagacgcacccuccaccuucggaacccgcaaccccaacaaugacuccgcaaucguaacccaauucgcccccggaacaaaacuccccaaaaacuuccacaucgaaggcaccggcggcaacucacaauccuccucgcgcgccuccagcgucucccgcaacagcucccgcuccagcagccaaggaucaagauccggcaacagcacccgcggcacaagccccgucccauccggaaucggagcuguagggggagaccucuuauaccuugaccuccucaaccgccuacaagcccuagaaucaggcaaagucaaacaaagccaacccaaagucauuacgaaaaaagaugcagccgcagccaaaaacaaaaugcgccacaaacgaacaagcacuaaauccuucaacaugguacaagccuucggucuccgcggccccggcgaccuccaaggaaacuucggcgaccuccaacugaacaaacuaggcaccgaagacccacgcuggccacagauagccgaacucgcccccaccgccagcgcauucaugggcaugagccaauucaaacuaacacaccaaaacaacgacgaccacggaaaccccgucuacuuucucagauacuccggcgccaucaaacucgaccccaaaaacccaaacuacaacaaauggcuagagcuccuagaacaaaacaucgacgcauacaaaaccuuccccaaaaaagaaaaaaaacaaaaagcacccaaagaagaaucaacagaccaaauguccgaaccccccaaagaacaacgcguccaaggcuccaucacccaacgcaccagaaccagacccucaguccaacccggaccaaugauagacgucaacaccgacuaa

SEQ ID NO: 1352 - RNA, 1242 nt, Artificial Sequence
  derived and/or modified CDS sequence (opt11) from MERS-CoV__AIZ74424__N
auggccgcgccagccgcacccagagcagucuccuucgccgacaacaacgacaucacgaacacaaaccugucacgcggccgaggcagaaacccaaaaccccgagcugccccuaacaacaccgucucaugguacacgggccucacccaacacggcaaaguaccccucacauucccaccaggccagggagucccccucaacgcaaacuccacuccagcccaaaacgcaggcuacuggcgccgacaagaccgaaaaaucaacaccggcaacggcauaaaacaacuagcccccagaugguacuucuacuacaccggcacaggacccgaagcggcccuccccuuccgagcagucaaagacggcaucgucuggguccacgaagacggcgccaccgacgcucccuccaccuucggcacccgaaaccccaacaacgacuccgccaucgucacacaauucgcacccggaaccaagcuacccaaaaacuuccacaucgaaggcacaggcggaaacucacaaucuuccagccgagccuccucaguaucucgcaacaguucgcgcucaagcucccaaggcuccagaagcggcaacuccacccgcggaacuagcccaggcccaaguggcaucggcgccguuggcggcgaccuccuauaccucgaccuccuaaaccgacuacaagcacucgaauccggcaaagucaaacaaucacaaccaaaaguaaucaccaaaaaggacgccgccgccgcuaaaaacaaaaugcgccacaaaagaacaagcaccaaaucauucaacaugguacaagccuucgggcuccgcggacccggagaccuccaaggcaacuucggcgaccuccaacucaacaaacucggcacugaggacccccgauggccccaaauagcagaacuagcccccacagccuccgccuucaugggaaugucccaauucaaauuaacacaccaaaacaaugaugaccacggcaacccaguauacuuccuacgcuacucaggcgcaauuaaacucgaccccaaaaacccaaacuacaacaaauggcucgagcuacuagaacaaaacauagacgccuacaagaccuucccaaagaaagaaaagaaacaaaaagcccccaaagaagaauccaccgaccaaauguccgaacccccaaaagaacaacggguucaaggcuccaucacacaacgcacccgcaccagacccuccguccaacccggacccaugaucgacguaaacaccgacuaa

SEQ ID NO: 1353 - RNA, 1242 nt, Artificial Sequence
  derived and/or modified CDS sequence (opt11) from MERS-CoV__AIZ74430__N
auggcagcaccagcagcaccccgcgccgucagcuucgccgacaacaacgacaucaccaacaccaaccuaucccgcggacgaggacgaaaccccaaaccccgugccgcccccaacaacaccguauccugguacaccggccucacucaacacggcaaaguuccccucaccuucccacccggacaaggcgucccccuaaaugccaacuccaccccagcccaaaacgccggauacuggcgccgacaagaccgcaaaaucaacaccggaaacggcaucaaacaacucgccccucgcugguacuucuacuacaccggcacgggacccgaagccgcccuccccuuccgcgcaguaaaagacggcauugucuggguccacgaagacggagccaccgacgcacccagcaccuucggaacccgcaaccccaacaacgacuccgccaucgucacccaauucgcccccggcaccaaacuacccaaaaacuuccacaucgaaggcaccggagguaacucccaauccagcucccgagcauccuccgucagccguaacuccucaagauccucaucacaaggcucccgcuccggcaacucaacacgcggcaccagucccggaccaucugguaucggagcagugggcggcgaccuccuauaccucgaccuacucaaccgcuuacaagcccucgaaucaggcaaagucaaacaaucacaacccaaagucaucaccaagaaagacgcagccgccgccaaaaacaaaaugcgccacaaacgcaccucaaccaaauccuucaacaugguccaagccuucggccuccgaggccccggcgaccuccaaggaaacuucggcgaccuacaacuaaauaaacucggcacagaagacccccgcuggccacaaaucgcagaacucgcacccacagcauccgccuucauggguaugucccaguucaaacuaacccaccaaaacaacgacgaccacggaaaccccgucuacuuccuacgauacucaggagcuauaaaacucgaccccaagaacccaaacuauaacaaauggcucgaacuacuugaacaaaacauagacgccuacaaaacauuccccaagaaagaaaagaaacaaaaagcacccaaagaagaauccaccgaccaaaugucagaacccccaaaagaacaacgaguacaaggcucaaucacccaacgaacccgcacccgccccucaguacaacccggacccaugaucgacgucaacacagacuaa

SEQ ID NO: 1354 - RNA, 1242 nt, Artificial Sequence
  derived and/or modified CDS sequence (opt11) from MERS-CoV__AKI29291__N
auggccucccccgcagccccacgagccgucucauucgccgacaauaacgauaucacaaacaccaaccuaucccgcggccgcggccgaaaccccaaaccccgcgccgcccccaacaacaccgucucaugguacaccggccuaacccaacacggaaaaguaccccucaccuuccccccuggccaaggcgucccccucaacgccaacuccacccccgcccaaaacgccggauacuggcgacgacaagaccgaaaaaucaacaccggaaacggcauaaaacaacucgccccccguugguacuucuacuacaccggaaccggaccagaagcagccuuacccuuccgcgccguaaaagacggcaucgucuggguccacgaagacggagccacagacgccccaucaaccuucggaacccguaacccaaacaacgacuccgccauagucacacaauucgcccccggcacaaaacucccaaaaaacuuccacaucgagggaaccggcggcaacucccaauccucaucccgcgcaucguccgucucacgcaacuccucacgcuccagcucccaaggcucacgauccggcaacuccacccgagguacaucaccaggacccuccggcaucggcgccgucggcggcgaccugcuuuaccucgaccuacucaaccgacuccaagcccuugaaagcggcaaagucaaacaaucccaacccaaagucaucacaaaaaaagacgcggccgcagcaaaaaacaaaaugcgacacaaaagaaccucaaccaaaucauuuaacaugguacaagcauucggccugcguggcccaggcgaccuccagggcaacuucggcgaccuucaacucaacaaacucggcaccgaagacccccgcuggccccagauagccgaacuugccccaacagcaucagccuucaugggcaugucacaauucaagcucacacaccaaaacaacgacgaccacgguaaucccgucuacuuccuccgcuacagcggagccaucaaacuagaccccaaaaacccaaauuacaacaaauggcucgaacuccuugaacagaacaucgacgccuacaaaaccuuccccaagaaagaaaaaaaacaaaaagcccccaaagaagaauccaccgaccaaaugagcgaaccccccaaagaacaacgcguccaaggcucaauaacccaacgcauccgaacccgccccuccguccaaccaggccccaugaucgacgucaacaccgacuag

SEQ ID NO: 1355 - RNA, 1242 nt, Artificial Sequence
  derived and/or modified CDS sequence (opt11) from MERS-CoV__AKK52599__N
auggccucuccugccgccccaugcgccguuuccuucgcagacaacaacgacauaaccaacaccaaccucuccagaggccgcggccgcaaccccaaaccccgugcagcccccaacaacacagucucaugguacacgggccuaacccagcacggcaaaguuccacucaccuucccccccggccaaggagucccccucaacgccaauucaacacccgcacaaaacgccggcuacuggagacgccaagaccgcaaaaucaacacaggcaacgguaucaaacaacucgcaccucgaugguacuucuacuacaccggcaccggccccgaagccgcccuccccuuccgcgccgucaaagacggcauugucuggguccacgaagacggagcaaccgacgcacccuccaccuucggaacacgcaaccccaacaacgauuccgccaucgucacccaauucgcacccggcacaaaacuccccaaaaacuuccacaucgagggaaccggcggcaacucccaauccuccucccgcgccuccuccgucucccgcaacuccucucgcagcuccucccaaggauccagaucuggcaacucaacucgcggcaccucacccggcccaucaggaaucggagcagugggcggcgaccuacucuaccucgaccuccucaaccgguuacaagcacucgaauccggaaaaguaaaacaaagccaaccaaaaguaaucaccaaaaaagacgccgccgcagccaaaaacaaaaugcgacauaaacgcaccagcaccaaauccuucaacaugguacaagcauucggacucagaggccccggcgaccuccaaggcaacuucggcgaccuccaacucaacaaacucggcaccgaagacccccgcuggccccaaaucgcagaacucgcccccaccgccuccgcauucaugggcaugucacaauucaaacuaacacaccaaaacaacgacgaccacggcaacccagucuacuuccucagauacucaggagcaaucaagcucgacccaaaaaacccaaacuacaacaaauggcuagaacuccuagaacaaaacaucgacgccuacaaaacauuccccaaaaaagaaaaaaaacaaaaagcccccaaagaagaaucaaccgaccaaaugagcgagcccccgaaagaacaacgcguacaaggcucaaucacacaacgaacccgaacccguccaucaguacaaccuggucccaugaucgacgucaacaccgacuaa

SEQ ID NO: 1356 - RNA, 1242 nt, Artificial Sequence
  derived and/or modified CDS sequence (opt11) from MERS-CoV__AKN24774__N
auggccagccccgccgccccgcgcgccgucagcuucgccgacaacaacgacaucacaaacaccaaccucagccggggccgcggcagaaaccccaaaccucgcgcagcccccaacaacacaguauccugguacaccggccuaacacaacacggcaaaguaccccucaccuuccccccugggcaaggcgucccacuaaacgcaaacucaacccccgcacaaaacgccggcuacuggcgucgccaagaccgaaaaauaaacacaggcaacggaauaaaacaacuagccccccgcugguacuucuacuacacugguacaggccccgaagccgcacuacccuuccgagcagucaaagacggcauagucuggguccaugaagacggcgccaccgacgcccccucaaccuucggcacccgcaaucccaacaacgaccucgccaucgucacacaguucgcacccggcaccaaacuacccaaaaacuuucacauagaaggcaccggaggcaacucccaauccuccucacgcgccagcucagucucacgaaacucuucccgaagcuccucccaaggaucccgguccggcaauuccacacgcggaacaagcccaggaccuuccggcauaggagccgucggcggcgaccuacucuaccuagaucuccuaaaccgacuacaagcacuugaauccggaaaaguaaaacaaucccaacccaaagucaucaccaaaaaagaugcagcagccgcuaaaaauaagaugagacacaaacgcacuuccacaaaauccuucaacaugguacaggccuucggacuucgaggucccggcgaccuccaaggcaacuucggcgaccuccaacucaacaaacucggaaccgaagacccacgcuggccccaaaucgcagaacuugucccaacagccagcgcauucaugggcaugucccaauucaaacucacccaccaaaacaacgacgaccacggcaaccccgucuacuuccuccgcuacuccggagcgauaaaacucgacccuaaaaaccccaacuacaacaaauggcuagaacuccucgaacaaaacaucgacgccuacaaaaccuucccuaaaaaagagaaaaaacaaaaagcccccaaagaagaaucaacagaccaaaugucagaaccccccaaagaacagcgaguacaaggcucaaucacccaacacaccagaacccgcccauccguccaacccggccccaugaucgacgucaacacagacuaa

SEQ ID NO: 1357 - RNA, 1242 nt, Artificial Sequence
  derived and/or modified CDS sequence (opt11) from MERS-CoV__ALW82676__N
auggcaucccccgccgccccacgagcagucucauucgccgacaacaacgacacaacaaacacaaaccucucccgcggacgcggcaggaaccccaaaccacgcgcggcccccaacaacaccgucuccugguacacugggcucacccaacacggaaaagugccacuaacuuucccacccggacaaggcgucccccuuaacgcaaacucaacccccgcccaaaacgccggcuacuggcgccgacaagaccgcaaaauaaauacaggcaacggcaucaaacaacucgcaccccgcugguacuucuacuacaccggaaccggcccugaagccgcccuccccuuccgcgccgucaaagacggcaucguauggguacacgaagacggcgccaccgacgcccccuccaccuucggcacaagaaaccccaacaacgacuccgccaucgucacccaauucgcaccaggcaccaaacuuccuaaaaacuuccacaucgaaggcaccggcggaaacucccaauccuccucccgagcaagcucagucucacgaaacucaucacgcucaucaucacaaggcuccagauccgguaacuccacccggggcaccucacccggacccucaggcaucggcgccguaggaggagaccuccuauaucuagaccuccucaaccgccuacaggcacuugaauccggcaaagucaaacaaucacaacccaaaguaaucacaaagaaagacgcagcagccgccaaaaacaaaaugcgccacaaacgcaccagcaccaaauccuucaacaugguacaagccuucggccuccgcggccccggcgaccuccaaggaaauuucggcgaccuccagcuaaacaaacuaggaacagaagaccccagauggccccaaaucgccgaacuagcccccacagccuccgccuucaugggcaugucccaauucaaacucacccaccaaaacaacgacgaccacggcaaccccguauacuuccuccgcuauucaggcgcaaucaaacucgaccccaaaaacccaaacuacaacaaauggcucgaacuacuagaacaaaacaucgacgccuacaaaaccuucccaaagaaagaaaagaaacaaaaagccccaaaagaagagucaaccgaccaaauguccgaacccccaaaagagcaacgcguacaaggauccaucacccaacgcacccgcacccgcccauccguacaaccaggccccaugaucgacguaaacaccgacuaa

SEQ ID NO: 1358 - RNA, 1242 nt, Artificial Sequence
  derived and/or modified CDS sequence (opt11) from MERS-CoV__AMQ49033__N
auggccuccccagccgccccacgagccgucuucuucgccgacaacaacgacauaaccaacacaaaccuuagccgcggccgaggaagaaaccccaaaccgcgagccgccccaaacaacaccguaagcugguacacaggguuaacccaacacgggaaagucccccucaccuucccccccggccaaggagucccccucaacgcaaacuccacccccgcucaaaacgccggcuacuggcggcgacaagaccgcaaaaucaacaccggaaacggcaucaaacaacuagcaccccgcugguacuucuacuacaccggcaccggacccgaagccgcacuccccuuccgagccguaaaggauggcaucguauggguccacgaagacggcgccaccgaugcacccucaacauuuggcacacgaaaccccaacaacgacucagcaaucgucacacaauucgccccaggaaccaaacuacccaaaaacuuccacaucgagggcaccggaggaaacucccaaagcuccucccgugccucauccgucucaagaaacuccucccgcagcuccucacaaggaucccgaucggguaacuccacccgaggaacaucacccggcccaagcggaaucggcgccgucggaggcgaccuccucuaccucgaccuccucaaccgccuacaagcccuugaaagcggcaaagucaaacaaucacaacccaaagucaucaccaaaaaagacgcagcagccgccaaaaacaaaaugagacacaaacgcaccuccaccaaauccuucaacaugguccaagccuuuggccuccguggccccggcgaccuccaaggcaacuucggcgaccuccaauucaacaaacucggcaccgaagacccacgauggccccaaauagccgaacucgcaccaaccgcauccgccuucaugggcaugucccaauucaaacucacccaccaaaacaacgacgaccacggcaaccccguauacuuccuccgcuacagcggagccauuaaauuagaccccaaaaaccccaacuacaacaaauggcucgaacuccuugagcaaaauauagacgcauacaaaaccuucccaaaaaaagaaaaaaaacaaaaagcccccaaagaagaaucaaccgaccaaauguccgaaccaccaaaagaacaacgcguccaaggcuccaucacccaacgaacccggacccggccaucuguccaacccggcccaaugaucgacgucaacacugauuaa

SEQ ID NO: 1359 - RNA, 1242 nt, Artificial Sequence
  derived and/or modified CDS sequence (opt11) from MERS-CoV__AHL18098__N
auggccucaagcgccgcacccagagccguaucauucgccgacaacaacgacaucaccaacaccaaccuaucccgcggccgaggcaggaauccuaaaccccgcgcagccccaaacaacaccguauccugguacaccggccucacacaacacggaaaagucccucucaccuucccacccggccagggaguaccccuaaacgccaacuccacacccgcccaaaacgccggcuacuggcgaagacaagaccguaaaaucaacacgggaaacggaauaaaacaacucgcgccccggugguacuucuacuacacaggaaccggaccagaggccgcccuacccuucagagcagucaaagacggaaucgucuggguacacgaagacggagccacagaugcacccucaaccuucggaacacgcaacccaaacaacgacuccgccaucguaacacaauucgcucccggaaccaaacuccccaaaaacuuccacauugaaggcaccggaggcaacagccaaucaagcucacgcgcauccucagucucacgcaacuccucccgcucaagcucccaagggucacggagcggcaacuccacccgaggcaccucacccgggccauccggaaucggcgccgucggaggagaccugcucuaccucgaccugcucaaccgucuccaagcccuagaaucaggaaaagucaaacaaucccaacccaaagucaucaccaagaaagacgccgccgccgccaaaaacaaaaugagacacaaacgcaccuccacaaaaucauucaacaugguccaagccuucggacuccgaggacccggcgaccuccaaggcaacuucggagaccugcaacucaacaaacucggcacagaagacccccgcuggccccaaaucgccgaacuagcccccaccgcuucagccuucaugggcaugucccaauucaaacucacacaucaaaacaacgacgaccauggcaacccaguauacuuccuacgcuauuccggcgcaauaaaacucgaucccaaaaaccccaacuacaacaaauggcucgaacuccucgaacaaaacaucgacgccuacaaaacauuccccaagaaagaaaacaaacaaaaagcgcccaaagaagaauccacagaccaaaugucagaaccacccaaagaacaacgcguacaaggcucaauaacccaacgcacccgcacccgucccuccguccaacccgggccaaugaucgacgucaacacagacuga

SEQ ID NO: 1360 - RNA, 1242 nt, Artificial Sequence
  derived and/or modified CDS sequence (opt11) from MERS-CoV__AHX00738__N
auggcagcccccgccgccccacgagcaguauccuucgccgacaauaacgacaucaccaacaccaacaugagccgcggccgaggccgcaaccccaaaccccgugccgcacccaacaacaccguaagcugguacaccggccuaacccaacacggaaaagucccccucaccuucccaccaggacaaggaguaccccucaacgcaaacuccacccccgcccaaaacgccggcuacuggcgcagacaagaccgaaaaaucaacaccggcaacggaaucaaacagcucgcaccacgaugguacuucuacuacaccggaaccggcccagaagccgcccuacccuuccgcgccgucaaggacggcaucgucuggguacacgaagacggcgccacagacgcacccuccaccuucggaacacgcaaccccaacaacgacagcgcaaucgucacucaauucgcacccggcaccaaacuccccaaaaacuuccacaucgaagguaccggcggcaacucccaaagcagcucccgcgccagcuccgucucccgcaacagcagccgauccagcucccaaggcucccgauccggcaacuccacccgaggcacauccccaggccccucgggcaucggagccguaggcggggaccuccucuaccuagaccuccucaacaggcuccaagcccuagaaucuggcaaaguaaagcaaucacaacccaaagucaucacaaagaaagacgcagcagccgccaaaaacaaaaugcgacacaaacgcacuagcacaaaaucauuuaacaugguccaagcauucggccuacgaggacccggcgaccuccaaggcaauuucggcgaccuccaacugaacaaacucggaaccgaagacccacgauggccccaaauagccgaacuagccccaaccgcaucagccuucaugggcaugucacaauucaaacucacccaccaaaacaacgacgaccacggaaaccccgucuauuuccuucgauacuccggcgccaucaaacucgaccccaaaaauccaaacuacaacaaauggcucgaacuccucgaacaaaauauagacgcauacaaaacauuccccaagaaagaaaagaagcaaaaagcccccaaagaagaaagcacagaccaaaugucagaaccaccaaaagaacaaaggguccaaggcuccaucacccaaaggacccgaacacgcccaagcguacaacccggacccaugaucgacgucaacacagacuaa

SEQ ID NO: 1361 - RNA, 1242 nt, Artificial Sequence
  derived and/or modified CDS sequence (opt11) from MERS-CoV__AHY22561__N
auggccucccccgccgccccacgcgccgucucauucgccgacaacaacgacaucaccaacaccaaccucucccgcggccggggacgaaaccccaaaccccgagccgcacccaacaacaccguaagcugguacaccggccucacccaacauggcaaagucccccuaacauuccccccaggccaaggagucccccuuaacgccaacuccaccccagcacaaaacgccggcuauuggcgccgccaagaccgaaaaaucaacaccggaaacggcaucaaacaacuugcaccacgcugguacuucuacuacaccggcaccggcccagaagcggcccuccccuuccgagcagucaaagacggaauagucuggguacacgaagacggggccaccgacgccccaucaaccuucggcacacgcaaccccaacaacgacuccgcaaucguaacccaauucgcccccggcaccaaacuucccaaaaacuuccacauagaaggcacaggaggaaacucacaauccuccagccgagccuccuccguaucaagaaacuccucaagaucauccucucaagggucccguuccggcaacuccacaagaggcaccucccccggcccaucaggcaucggcgccguaggcggcgaccuccucuaccucgaccuccucaacagacuccaagcacucgaauccggcaaagucaaacaaucccaacccaaagucauaacgaaaaaagacgcagccgccgcaaaaaacaaaaugcgccacaaacgcaccucaacaaaauccuucaacaugguccaagcauucggccucagaggaccaggagaccuccagggaaacuucggcgaccuacaacugaacaaacuaggcaccgaagacccacgauggccccaaaucgcagaacucgcccccacagccagcgcauucaugggaaugagccaauucaaacucacccaccaaaacaacgacgaccacggaaacccagucuacuuccuuagauacuccggcgccaucaaacuagaccccaaaaaucccaacuacaacaaauggcuagaacuccuagaacaaaacaucgacgccuauaaaaccuuccccaagaaagaaaacaaacaaaaagcccccaaagaggaaucaaccgaccaaauguccgaaccacccaaagaacaacgaguacaaggcucaauaacccaacggacccgcacccgccccucgguccaacccggccccaugaucgacguaaacaccgacuaa

SEQ ID NO: 1362 - RNA, 1242 nt, Artificial Sequence
  derived and/or modified CDS sequence (opt11) from MERS-CoV__AHY22571__N
auggccgccccagccgcccccagagcagucucauucgccgacaacaacgacauaacaaacaccaaccuaucccgaggacgcggccgaaaccccaaacccagagcagcucccaacaacaccgucucaugguacaccggccucacccaacacggcaaaguaccucuaacauucccacccggccaaggcguaccccucaacgccaacucaacaccagcacaaaacgccggcuacuggcgccgccaagaccgcaaaaucaacaccggcaacggaaucaaacaacucgccccaagaugguacuucuacuacaccggcaccggccccgaagcugcccuccccuuccgcgccguaaaagacggcaucgucuggguccacgaagacggcgccaccgacgcacccucgaccuucggcacccgaaacccaaacaacgacucagcaaucguaacccaguucgcacccggcacaaaacuccccaaaaacuuccacaucgaggguacaggaggaaacucacaguccucaucacgcgcauccagcguaucacgaaacagcuccagauccuccucacaaggcucccgaucccgaaacagcacacgcggcaccagccccggccccucaggcaucggcgcagucggaggagaccuccuuuaccucgaccuccugaaccgccuacaagcacuugaaucaggcaaaguaaaacaaucccaaccaaaagucaucaccaagaaagacgccgccgccgccaaaaacaaaaugcgccacaaacgcacauccaccaaauccuucaauaugguacaagcauucgggcuacgaggccccggagaccuacaaggcaacuucggcgaccuccaacucaacaagcucggcaccgaagacccgcgcuggccccaaaucgcagaacuagccccuacagccuccgccuucaugggcaugagccaauucaaacucacccaucagaacaacgacgaccacggcaaccccgucuacuuccuaagauacuccggagcaaucaaacuagaccccaaaaaccccaacuauaacaaauggcucgagcuccucgaacaaaacaucgacgcauacaagaccuuccccaagaaagaaaacaaacaaaaagcaccaaaagaagaauccaccgaccaaaugagcgaaccaccaaaagaacaaagaguccaaggcucaaucacccaaaggacucgaacccgccccuccguccaacccggcccaaugaucgacgucaacaccgacuaa

SEQ ID NO: 1363 - RNA, 1242 nt, Artificial Sequence
  derived and/or modified CDS sequence (opt11) from MERS-CoV__ALA49381__N
auggccucaccagccgccccacgagcaguaucauucgccgacaacaacgacaucaccaacaccaaccucagccgcggacgcggacgcaauccaaaaccacgagccgcccccaacaacaccgucagcugguacaccgggcuaacacagcacggcaaagucccccuaacauucccccccggccaaggcguccccuuaaacgccaacuccacccccgcacaaaacgcaggauauuggcgacgacaagaccggaaaaucaacaccggaaacggcauaaaacaacucgcaccccgcugguacuucuacuacacugguaccggucccgaagcagcccuaccauuccgcgcaguaaaagacggcaucguauggguccacgaagacggcgccaccgacgcacccuccaccuucggcacacgcaaccccaauaacgacuccgccaucgucacacaauuugcccccggcaccaaauuaccaaaaaacuuccacauagaaggaaccggcggcaacucccaauccagcucccgcgcauccucugucucacgcaacuccucacgcucaucaucacaaggaucacgauccggcaacuccacccgaggcuccuccccaggccccagcggcaucggagccguaggcggggaccuacucuaccucgaccuccuaaaccgccuccaagcccuugaauccggcaaagucaaacaaucccaacccaaagucauaaccaaaaaagacgccgccgccgccaaaaacaaaaugcgccacaaacgcaccuccacuaaaucguucaacaugguccaagcauucggccuacgaggccccggcgaucuccaaggcaacuucggagaccuacaacucaacaaacucggaacagaagacccucguuggccccaaaucgccgaacuagcucccacagccuccgccuucaugggcaugucccaauucaaacucacccaccaaaacaacgacgaccacggcaaccccgucuacuuccuacgauacuccggagccaucaaacuagaccccaaaaacccaaacuacaacaaauggcuagaacuucuagaacaaaacauugacgcauacaaaacauuuccuaaaaaagaaaaaaaacaaaaagccccaaaagaggaauccaccgaccaaaugucagaaccccccaaagaacaacgcguccagggaucaaucacacaacgcacccgaacccgccccuccguccaaccaggcccaaugaucgacgucaacaccgacuaa

SEQ ID NO: 1364 - RNA, 1242 nt, Artificial Sequence
  derived and/or modified CDS sequence (opt11) from MERS-CoV__ALA49392__N
auggccucgccagccgccccacgcgccgucucauucgccgacaacaacgacaucaccaacacaaaccucucaagaggccgcggccgcaaccccaaaccccgagccgccccaaacaacaccgucuccugguacacaggccucacccaacacggcaaaguaccccucaccuucccccccggucaaggcguaccacucaacgcaaacucaacccccgcccaaaacgccggcuacuggcgccgccaagaccguaaaauaaacacaggcaacggcaucaaacaacuugccccccgaugguacuucuacuacacaggcaccggcccagaagcagcccuaccauuccgcgccgucaaagacggcaucgucuggguccacgaagacggagcaaccgacgcacccucaaccuucggcacccgaaaccccaacaacgacagcgccaucguaacccaauucgcccccggcacaaaacucccaaaaaacuuccacaucgaaggcacgggcggcaacucccaaucaagcucccgcgccucauccgucucucgcaacuccuccagauccagcucccaggguucccgcucaggcaacuccacuagaggaucuagcccaggcccaucuggaaucggcgccguaggcggcgaccuacucuaccuagaccuacucaaccgccuccaggcacucgaauccggcaaagucaaacagucccaaccuaaaguaaucaccaaaaaagacgcagccgccgccaaaaacaaaaugcggcacaaacgcaccuccaccaaaucauucaacaugguccaagccuucggccuccguggccccggcgaccuccaaggcaacuuuggagaccuacaacuaaacaaauuaggaaccgaagacccccguuggccacaaaucgccgaacuggccccaaccgccagcgccuucaugggcaugucccaauuuaaacucacccaccaaaacaaugacgaccacgguaacccagucuacuuccuccgcuacuccggcgccauaaaacucgacccaaaaaaccccaacuacaacaaauggcucgaacuccucgaacaaaacauagacgccuacaaaaccuuccccaaaaaagaaaaaaaacagaaagcacccaaagaagaauccaccgaccaaaugucugaaccccccaaagaacaacgcguccgaggcucaaucacacaacgaacacgcacacgccccucaguacaaccaggacccaugaucgacgucaacaccgacuaa

SEQ ID NO: 1365 - RNA, 1242 nt, Artificial Sequence
  derived and/or modified CDS sequence (opt11) from MERS-CoV__ALA49601__N
auggccucccccgcagccccccgcgccgucucuuucgcggacaacaacgacauaaccaacaccaaucucagccgcgguagaggccgcaacccgaaaccacgagccgcccccaacaacaccgucucaugguacaccggacucacccaacacgguaaagucccccucaccuucccccccggccaaggaguaccccucaacgccaauucaacccccgcccagaacgcaggcuacuggcgccgccaagaccgcaaaauaaacaccggcaacggcauaaaacaacucgccccccgcugguacuucuacuacaccggcaccggcccagaagccgcccuccccuuccgagccguaaaagacggcaucgucuggguccacgaagacggcgccaccgacgccccauccacuuucggcacacgaaaccccaacaacgacucugcaaucguaacacaauucgccccagggacaaaacucccaaaaaacuuccacauagaaggcaccggcggcaacucacaauccagcuccagagccuccagcguaucccgcaauuccucccgcuccuccucacaaggcuccagauccggaaacuccacccgcggcaccuccccaggccucuccggcaucggagccgucggcggcgaccuucuauaccucgaccuccucaaccgacuccaagccuuagaauccggaaaagucaaacaaucucaacccaaagucauaacaaaaaaagacgcagccgccgccaaaaacaaaaugcgccacaaacgcaccagcacaaaaaguuucaacaugguccaagcauucggccuccgcggccccggcgaccuacaaggcaacuucggagaccuacagcucaacaaacucggcaccgaggacccacgcuggccacaaaucgccgaauuagccccaacagccuccgccuucaugggcaugagccaauucaaacuuacccaccaaaacaacgacgaccacggaaacccagucuacuuccuucgauacuccggcgccaucaaacuagaccccaaaaacccaaacuacaacaaauggcucgagcuacuagaacaaaacaucgacgcauacaaaaccuuucccaaaaaagaaaaaaaacaaaaagcaccaaaagaggaauccacugaucaaaugagcgaaccacccaaagaacaaagaguccaagguuccauuacccaacggacccgcacccgucccuccguccaacccggcccaaugauagauguaaacaccgacuaa

SEQ ID NO: 1366 - RNA, 1242 nt, Artificial Sequence
  derived and/or modified CDS sequence (opt11) from MERS-CoV__ALA49843__N
auggccucgcccgccgcaccccgcgccgucuccuucgccgacaacaacgacaucacgaacaccaaccucagcagaggacgcggccggaaccccaaacccagggccgcccccaacaacaccguuucaugguacaccggccuaacccagcacggcaaaguaccacuaaccuucccaccuggucaaggcgucccccuaaacgcaaacucaaccccagcccaaaacgcuggauacuggcgccgacaagacagaaagauaaacaccgguaauggcaucaaacaacuagcccccagaugguacuucuacuacaccggaaccggacccgaagcggcacuaccauuccgcgccgucaaagacggcaucgucuggguacacgaggacggagccaccgacgcacccuccaccuucggcacacgaaaccccaacaacgacuccgcaaucguaacccaauucgcccccggcacaaaacuccccaaaaacuuccacaucgagggcaccggaggaaacucccaauccucaucccgcgccucaucugucucaagaaacuccucccgcuccuccucccaaggcagccgauccggcaacuccacacgaugcacaucucccggacccuccggaaucggagccguaggcggagaccuccucuaccuugaccuccucaaccgccuccaagcccucgaauccggcaaagucaaacaaucucaaccaaaaguaaucaccaagaaagacgcagccgccgccaaaaacaaaaugcgccacaaacgaaccagcaccaaauccuucaacaugguccaagcauucggacuacgaggacccggcgaccuccaaggcaacuucggagaccuccaacucaacaaacuaggaaccgaagacccacgcuggccccaaaucgcagaacuagccccgaccgcaagugccuucaugggcaugucgcaauucaaacuaacccaccaaaacaaugacgaccacggcaaccccgucuacuuccugcgauacuccggggccaucaaacuagaccccaaaaaccccaacuacaacaaauggcuggaacugcucgaacaaaacaucgacgcauacaaaaccuuccccaaaaaggaaaagaaacaaaaagccccuaaagaagaauccacagaccaaauguccgaaccacccaaagaacaacgcguccaaggcuccaucacccaacgaaccagaacacgcccauccguccaaccaggccccaugaucgacgucaacaccgacuaa

SEQ ID NO: 1367 - RNA, 1242 nt, Artificial Sequence
  derived and/or modified CDS sequence (opt11) from MERS-CoV__ALA49865__N
auggccuccccagcagccccacgcgccguaucauucgcagacaacaacgacaucacaaacaccaaccucagccgcggccgcggacgaaacccaaaaccucgagcagccccaaacaacaccguauccugguacaccggccucacccaacacggcaaagucccccuaaccuuucccccaggccaaggaguaccuuuaaacgcgaacuccacacccgcccaaaacgccggcuacuggcgccgucaggaucggaaaaucaacacaggaaacggcaucaaacaacucgccccucgaugguacuucuacuacaucggcaccggcccagaagcggcccugcccuuccgcgcuguaaaagacggcauagucuggguccacgaagacggcgccaccgacgcccccuccaccuucggaacacgcaaccccaacaacgacuccgccauaguaacccaauucgcacccggcaccaaacuccccaaaaacuuccacauagaagguaccggcggcaacucccaaucaagcucccgagcaagcuccgucucccgcaacuccucccgcucauccagccaaggcagccgcagcggaaacuccaccagaggcaccagccccggccccuccggcaucggcgccgucggcggagaccugcuauaccucgaccuacuaaaccgccuccaagccuuagaaucaggcaaagucaaacaaucacaacccaaagucaucacgaagaaagacgccgccgccgccaaaaacaaaaugcgccacaaacgaaccagcacaaaauccuucaacaugguccaagcauucggacuccguggccccggcgaccuccaaggcaacuucggcgaccuucaacucaauaaacuaggaaccgaagacccccgcuggccucaaaucgcagaacucgcccccacugcgagcgccuucaugggcaugucacaauucaaacucacacaccagaacaacgacgaccacggaaaccccgucuacuuccuccguuacagcggagccaucaaacucgaccccaaaaaccccaauuacaacaaauggcucgaacuccucgaacaaaacaucgacgccuacaaaacauuccccaagaaagaaaagaaacaaaaagccccaaaagaagaauccacugaccaaaugagcgaaccacccaaagaacaacgcguacaaggauccaucacccaaagaaccagaaccagaccaucaguccaacccggccccaugauagacgucaacaccgacuaa

SEQ ID NO: 1368 - RNA, 1242 nt, Artificial Sequence
  derived and/or modified CDS sequence (opt11) from MERS-CoV__ALA49909__N
auggccucccccgcagcaccccgcgcugucucuuucgccgacaacaacgacaucacaaacacaaaccucucccgcggccgcggccgcaacccaaaaccccgcgccgcacccaacaacaccgucucaugguacacaggccucacacaacacggcaaagucccacuaaccuuccccccaggucaaggcgucccacucaacgcaaacuccacacccgcacaaaacgccggcuacuggcgccgccaagacagaaaaauaaacaccggaaacggaauaaaacaauuagcaccccgcugguacuucuacuacaccggaaccggacccgaagccgcccuacccuuccgcgccgucaaggacggaaucgucuggguacacgaacauggagccaccgacgcacccuccacauucggcacccgcaaccccaacaacgacuccgccaucguaacccaauucgcacccgguacaaaacuaccaaaaaacuuccacaucgaaggcaccggcggcaacagccaaagcuccucacgcgccuccagcguaucacgcaacuccuccagauccuccucccaaggcucccgaucaggcaacuccaccagaugcaccucccccggacccuccggaauaggcgccgucggcggagaccuccuauaccucgaccuccucaacagacuacaagcccuagaauccggaaaagucaaacaaucccaacccaaagucaucaccaaaaaggacgccgccgcggccaaaaacaaaaugcgacacaaaagaacuuccaccaaauccuucaacaugguacaagccuucggacuacgaggccccggagaccugcaaggcaacuucggagaccuccaacuaaacaaacucggaaccgaagacccccgcuggccacaaaucgccgaacuagcucccacugccuccgccuucauggggaugucccaauucaaacucacccaccaaaacaacgacgaccacggcaaccccguauacuuccuccguuacuccggagccaucaaacuugacccaaaaaacccaaacuacaacaaauggcuagaacuccuagaacaaaacaucgacgcauacaaaaccuuccccaaaaaagaaaaaaaacaaaaagcaccuaaagaagaauccaccgaccaaauguccgaaccacccaaagaacaaagaguccaaggcuccauuacacagagaacccgcacccgccccuccguacaaccaggccccaugaucgacgucaauaccgacuaa

SEQ ID NO: 1369 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 1370 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 1371 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 1372 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 1373 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 1374 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 1375 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 1376 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 1377 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 1378 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 1379 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 1380 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 1381 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 1382 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 1383 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 1384 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 1385 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 1386 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 1387 - DNA, 24 bp, Artificial Sequence
  histone stem-loop sequence (histoneSL, hSL)
caaaggctcttttcagagccacca

SEQ ID NO: 1388 - RNA, 24 nt, Artificial Sequence
  histone stem-loop sequence (histoneSL, hSL) mRNA
caaaggcucuuuucagagccacca

SEQ ID NO: 1389 - DNA, 13 bp, Artificial Sequence
  Kozak
gccgccaccatgg

SEQ ID NO: 1390 - RNA, 13 nt, Artificial Sequence
  Kozak mRNA
gccgccaccaugg

SEQ ID NO: 1391 - protein, 15 aa, Artificial Sequence
  derived and/or modified protein sequence (wt) from Clostridium tetani__WP_023439719__CLOTE(E88_pE88)-tetX(830-844) (helper peptide)
QYIKANSKFIGITEL

SEQ ID NO: 1392 - protein, 24 aa, Artificial Sequence
  derived and/or modified protein sequence (wt) from Homo sapiens__AAA59606__HsHLA-A2(1-24)
MAVMAPRTLVLLLSGALALTQTWA

SEQ ID NO: 1393 - protein, 23 aa, Artificial Sequence
  derived and/or modified protein sequence (wt) from Homo sapiens__AAA61213__HsPLAT(1-23)
MDAMKRGLCCVLLLCGAVFVSPS

SEQ ID NO: 1394 - protein, 21 aa, Artificial Sequence
  derived and/or modified protein sequence (wt) from Homo sapiens__AAA61213__HsPLAT(1-21)
MDAMKRGLCCVLLLCGAVFVS

SEQ ID NO: 1395 - protein, 22 aa, Artificial Sequence
  derived and/or modified protein sequence (wt) from Homo sapiens__AAA61213__HsPLAT(1-22)
MDAMKRGLCCVLLLCGAVFVSP

SEQ ID NO: 1396 - protein, 27 aa, Artificial Sequence
  derived and/or modified protein sequence (wt) from Homo sapiens__NP_000790__HsEPO(1-27)
MGVHECPAWLWLLLSLLSLPLGLPVLG

SEQ ID NO: 1397 - protein, 18 aa, Artificial Sequence
  derived and/or modified protein sequence (wt) from Homo sapiens__NP_000468__HsALB(1-18)
MKWVTFISLLFLFSSAYS

SEQ ID NO: 1398 - protein, 18 aa, Artificial Sequence
  derived and/or modified protein sequence (wt) from Homo sapiens__AAB59424__HsIgE(1-18)
MDWTWILFLVAAATRVHS

SEQ ID NO: 1399 - protein, 24 aa, Artificial Sequence
  derived and/or modified protein sequence (wt) from Homo sapiens__NP_055022__HsCD5(1-24)
MPMGSLQPLATLYLLGMLVASCLG

SEQ ID NO: 1400 - protein, 20 aa, Artificial Sequence
  derived and/or modified protein sequence (wt) from Homo sapiens__NP_000577__HsIL2(1-20)
MYRMQLLSCIALSLALVTNS

SEQ ID NO: 1401 - protein, 18 aa, Artificial Sequence
  derived and/or modified protein sequence (wt) from Homo sapiens__NP_001020371 __HsCTRB2(1-18)
MAFLWLLSCWALLGTTFG

SEQ ID NO: 1402 - protein, 19 aa, Artificial Sequence
  derived and/or modified protein sequence (wt) from Homo sapiens__BAC87457__HsIgG-HC(1-19)
MEFGLSWVFLVALFRGVQC

SEQ ID NO: 1403 - protein, 19 aa, Artificial Sequence
  derived and/or modified protein sequence (wt) from Homo sapiens__AAA52897__HsIg-HC(1-19)
MDWTWRVFCLLAVTPGAHP

SEQ ID NO: 1404 - protein, 19 aa, Artificial Sequence
  derived and/or modified protein sequence (wt) from Homo sapiens__AAA59018__HsIg-LC(1-19)
MAWSPLFLTLITHCAGSWA

SEQ ID NO: 1405 - protein, 17 aa, Artificial Sequence
  derived and/or modified protein sequence (wt) from Gaussia princeps__AAG54095__GpLuc(1-17)
MGVKVLFALICIAVAEA

SEQ ID NO: 1406 - protein, 21 aa, Artificial Sequence
  derived and/or modified protein sequence (wt) from Mus musculus__BAR42292__MmIgkappa(1-21)
METDTLLLWVLLLWVPGSTGD

SEQ ID NO: 1407 - protein, 26 aa, Artificial Sequence
  derived and/or modified protein sequence (wt) from Nepenthes rafflesiana__ABF74624__NrChit1(1-26)
MKTHYSSAILPILTLFVFLSINPSHG

SEQ ID NO: 1408 - protein, 21 aa, Artificial Sequence
  derived and/or modified protein sequence (wt) from Conus leopardus__AAS93426__ClLp1.1(1-21)
MGMRMMFIMFMLVVLATTVVS

SEQ ID NO: 1409 - protein, 24 aa, Artificial Sequence
  derived and/or modified protein sequence (wt) from Nepenthes gracilis__AB114914__NgNep1(1-24)
MASSLYSFLLALSIVYIFVAPTHS

SEQ ID NO: 1410 - protein, 19 aa, Artificial Sequence
  derived and/or modified protein sequence (wt) from Homo sapiens__NP_001691__HsAzu1(1-19)
MTRLTVLALLAGLLASSRA

SEQ ID NO: 1411 - protein, 16 aa, Artificial Sequence
  derived and/or modified protein sequence (wt) from Homo sapiens__AAA51948__HsCD33(1-16)
MPLLLLLPLLWAGALA

SEQ ID NO: 1412 - protein, 19 aa, Artificial Sequence
  derived and/or modified protein sequence (wt) from Vibrio cholerae__BAA06291__VcCtxB(1-19)
MIKLKFGVFFTVLLSSAYA

SEQ ID NO: 1413 - protein, 20 aa, Artificial Sequence
  derived and/or modified protein sequence (wt) from Homo sapiens__NP_001890__HsCST4(1-20)
MARPLCTLLLLMATLAGALA

SEQ ID NO: 1414 - protein, 24 aa, Artificial Sequence
  derived and/or modified protein sequence (wt) from Homo sapiens__AAA59172__HsIns-iso1(1-24)
MALWMRLLPLLALLALWGPDPAAA

SEQ ID NO: 1415 - protein, 17 aa, Artificial Sequence
  derived and/or modified protein sequence (wt) from Homo sapiens__CAA68724__HsSPARC(1-17)
MRAWIFFLLCLAGRALA

SEQ ID NO: 1416 - protein, 17 aa, Artificial Sequence
  derived and/or modified protein sequence (wt) from Inluenza A__ACQ45338__H1N1-HA(1-17)
MKAILVVLLYTFATANA

SEQ ID NO: 1417 - protein, 46 aa, Artificial Sequence
  derived and/or modified protein sequence (wt) from Influenza virus____Transmembrane domain of HA
KLESTRIYQILAIYSTVASSLVLVVSLGAISFWMCSNGSLQCRICI

SEQ ID NO: 1418 - protein, 17 aa, Artificial Sequence
  derived and/or modified protein sequence (wt) from Human immunodeficiency virus 1__BAF32550__Transmembrane domain of Env
LILGLVIICNASNNLWV

SEQ ID NO: 1419 - protein, 22 aa, Artificial Sequence
  derived and/or modified protein sequence (wt) from Human immunodeficiency virus 1__BAF32550__Transmembrane domain of Env
GIGAMIFGFLGAAGSTMGAASI

SEQ ID NO: 1420 - protein, 23 aa, Artificial Sequence
  derived and/or modified protein sequence (wt) from Human immunodeficiency virus 1__BAF32550__Transmembrane domain of Env
LWYIRLFIMIVGGLIGLRIIFAV

SEQ ID NO: 1421 - protein, 23 aa, Artificial Sequence
  derived and/or modified protein sequence (wt) from Equine infectious anemia virus__AAC03762__Transmembrane domain of Env
AIVAAIVAATAIAASATMSYVAL

SEQ ID NO: 1422 - protein, 23 aa, Artificial Sequence
  derived and/or modified protein sequence (wt) from Equine infectious anemia virus__AAC03762__Transmembrane domain of Env
WIPGLGASIIKYIVMFLLIYLLL

SEQ ID NO: 1423 - protein, 22 aa, Artificial Sequence
  derived and/or modified protein sequence (wt) from Equine infectious anemia virus__AAC03762__Transmembrane domain of Env
LFWGLVIIVGRIAGYGLRGLAV

SEQ ID NO: 1424 - protein, 23 aa, Artificial Sequence
  derived and/or modified protein sequence (wt) from Murine leukemia virus__AAA46526__Transmembrane domain of Env
WFTTLISTIMGPLIVLLLILLLG

SEQ ID NO: 1425 - protein, 23 aa, Artificial Sequence
  derived and/or modified protein sequence (wt) from Mouse mammary tumor virus__BAA03768__Transmembrane domain of Env
FVAAIILGISALIAIITSFAVAT

SEQ ID NO: 1426 - protein, 23 aa, Artificial Sequence
  derived and/or modified protein sequence (wt) from Mouse mammary tumor virus____Transmembrane domain of Env
YFIFIGVGALLLVIVLMIFPIVF

SEQ ID NO: 1427 - protein, 23 aa, Artificial Sequence
  derived and/or modified protein sequence (wt) from Vesicular stomatitis virus__CAA24525__Transmembrane domain of G protein
AVIIGFVILMFLIKLIGVLSSLF

SEQ ID NO: 1428 - protein, 20 aa, Artificial Sequence
  derived and/or modified protein sequence (wt) from Rabies virus__AEV43288__Transmembrane domain of G protein
VLMGAGVLTALMLMIFLMTC

SEQ ID NO: 1429 - protein, 149 aa, Artificial Sequence
  derived and/or modified protein sequence (wt) from Woodchuck hepatitis virus__NP_671816__VLP forming subunit of WHcAg
DIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 1430 - protein, 221 aa, Artificial Sequence
  derived and/or modified protein sequence (wt) from Alfalfa mosaic virus__NP_041195__VLP forming subunit of CP
MSSSQKKAGGKAGKPTKRSQNYAALRKAQLPKPPALKVPVVKPTNTILPQTGCVWQSLGTPLSLSSFNGLGVRFLYSFLKDFAGPRILEEDLIYRMVFSITPSYAGTFCLTDDVTTEDGRAVAHGNPMQEFPHGAFHANEKFGFELVFTAPTHAGMQNQNFKHSYAVALCLDFDAQPEGSKNPSYRFNEVWVERKAFPRAGPLRSLITVGLLDEADDLDRH

SEQ ID NO: 1431 - protein, 9 aa, Artificial Sequence
  derived and/or modified protein sequence (artificial) from Artificial____peptide linker 1
GGGGSGGGG

SEQ ID NO: 1432 - protein, 14 aa, Artificial Sequence
  derived and/or modified protein sequence (artificial) from Artificial____peptide linker 2
GGGGSGGGGSGGGG

SEQ ID NO: 1433 - protein, 5 aa, Artificial Sequence
  derived and/or modified protein sequence (artificial) from Artificial____peptide linker 3
GSGSG

SEQ ID NO: 1434 - protein, 22 aa, Artificial Sequence
  derived and/or modified protein sequence (wt) from Foot-and-mouth disease virus____F2Amod1
VKQTLNFDLLKLAGDVESNPGP

SEQ ID NO: 1435 - protein, 22 aa, Artificial Sequence
  derived and/or modified protein sequence (wt) from Foot-and-mouth disease virus____F2Amod2
VKQTLNFDLLKLAGDVESNPGP

SEQ ID NO: 1436 - RNA, 66 nt, Artificial Sequence
  derived and/or modified CDS sequence (wt) from Foot-and-mouth disease virus____F2Amod1
gugaagcagacacucaauuucgaccuucugaaguuggcuggagauguugagucuaacccaggcccc

SEQ ID NO: 1437 - RNA, 66 nt, Artificial Sequence
  derived and/or modified CDS sequence (wt) from Foot-and-mouth disease virus____F2Amod2
gucaaacagaccuugaacuucgacuugcucaaacuggccggggauguggaguccaauccuggaccu

SEQ ID NO: 1438 - RNA, 671 nt, Artificial Sequence
  derived and/or modified CDS sequence (wt) from Encephalomyocarditis virus____EMCV-IRES-4
uugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuacc

SEQ ID NO: 1439 - RNA, 461 nt, Artificial Sequence
  derived and/or modified CDS sequence (wt) from Foot-and-mouth disease virus____FMDV-IRES
agcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccu

SEQ ID NO: 1440 - protein, 14 aa, Artificial Sequence
  carrier peptide 1
CRRRRRRRRRRRRC

SEQ ID NO: 1441 - protein, 13 aa, Artificial Sequence
  carrier peptide 2
CRRRRRRRRRRRR

SEQ ID NO: 1442 - protein, 14 aa, Artificial Sequence
  carrier peptide 3
WRRRRRRRRRRRRC

SEQ ID NO: 1443 - protein, 18 aa, Artificial Sequence
  carrier peptide 4
CHHHHHHRRRRHHHHHHC

SEQ ID NO: 1444 - RNA, 99 nt, Artificial Sequence
  3'-end A75-histoneSL
aaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1445 - RNA, 102 nt, Artificial Sequence
  3'-end U3-A75-histoneSL
uuuaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1446 - RNA, 178 nt, Artificial Sequence
  3'-end A154-histoneSL
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1447 - RNA, 181 nt, Artificial Sequence
  3'-end U3-A154-histoneSL
uuuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 1448 - protein, 747 aa, Artificial Sequence
  derived and/or modified protein sequence (wt) from MERS-CoV__AFS88936__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1449 - protein, 747 aa, Artificial Sequence
  derived and/or modified protein sequence (wt) from MERS-CoV__AFY13307__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRFLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1450 - protein, 747 aa, Artificial Sequence
  derived and/or modified protein sequence (wt) from MERS-CoV__AGH58717__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATVTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSILSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1451 - protein, 747 aa, Artificial Sequence
  derived and/or modified protein sequence (wt) from MERS-CoV__AGN52936__S1
MIHSVFLLMFLLTPTESYVDVGPDSIKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1452 - protein, 747 aa, Artificial Sequence; identical to SEQ ID NO: 1448
  derived and/or modified protein sequence (wt) from MERS-CoV__AGN70951__S1

SEQ ID NO: 1453 - protein, 747 aa, Artificial Sequence
  derived and/or modified protein sequence (wt) from MERS-CoV__AGV08408__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSGDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1454 - protein, 747 aa, Artificial Sequence
  derived and/or modified protein sequence (wt) from MERS-CoV__AGV08455__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSYGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1455 - protein, 747 aa, Artificial Sequence; identical to SEQ ID NO: 1448
  derived and/or modified protein sequence (wt) from MERS-CoV__AGV08467__S1

SEQ ID NO: 1456 - protein, 747 aa, Artificial Sequence; identical to SEQ ID NO: 1448
  derived and/or modified protein sequence (wt) from MERS-CoV__AGV08492__S1

SEQ ID NO: 1457 - protein, 747 aa, Artificial Sequence
  derived and/or modified protein sequence (wt) from MERS-CoV__AGV08584__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTAWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1458 - protein, 747 aa, Artificial Sequence
  derived and/or modified protein sequence (wt) from MERS-CoV__AHB33326__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAAYSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1459 - protein, 747 aa, Artificial Sequence
  derived and/or modified protein sequence (wt) from MERS-CoV__AHC74088__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSFAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1460 - protein, 747 aa, Artificial Sequence
  derived and/or modified protein sequence (wt) from MERS-CoV__AHI48528__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPPAIASNCYSSLILDYFSYPLSMKSDLSVSSAGPISQFNYKQSFSNPTCLILVTVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1461 - protein, 747 aa, Artificial Sequence; identical to SEQ ID NO: 1448
  derived and/or modified protein sequence (wt) from MERS-CoV__AHI48550__S1

SEQ ID NO: 1462 - protein, 747 aa, Artificial Sequence
  derived and/or modified protein sequence (wt) from MERS-CoV__AHI48583__S1
MIHSVFLLMFLLTPTESYVDVGPDSVKSACIEVDIQQTFFDKTWPRPIDVFKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1463 - protein, 747 aa, Artificial Sequence; identical to SEQ ID NO: 1448
  derived and/or modified protein sequence (wt) from MERS-CoV__AHI48605__S1

SEQ ID NO: 1464 - protein, 747 aa, Artificial Sequence; identical to SEQ ID NO: 1450
  derived and/or modified protein sequence (wt) from MERS-CoV__AHY21469__S1

SEQ ID NO: 1465 - protein, 747 aa, Artificial Sequence
  derived and/or modified protein sequence (wt) from MERS-CoV__AHZ64057__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHIFSTMSQYSRSTRSMLKRRDSTYGPLQTPVGCVLGLVNSSLFVEDCKLPLGQSLCALPDTPSTLTP

SEQ ID NO: 1466 - protein, 747 aa, Artificial Sequence; identical to SEQ ID NO: 1448
  derived and/or modified protein sequence (wt) from MERS-CoV__AID50418__S1

SEQ ID NO: 1467 - protein, 747 aa, Artificial Sequence; identical to SEQ ID NO: 1448
  derived and/or modified protein sequence (wt) from MERS-CoV__AID55068__S1

SEQ ID NO: 1468 - protein, 747 aa, Artificial Sequence
  derived and/or modified protein sequence (wt) from MERS-CoV__AID55073__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1469 - protein, 747 aa, Artificial Sequence
  derived and/or modified protein sequence (wt) from MERS-CoV__AIY60528__S1
MIHSVFLLMFLLTPTESYVDVGPDSFKSACIEVDIQQTFFDKTWPRPIDVSKADGIIYPQGRTYSNITITYQGLFPYQGDHGDMYVYSAGHATGTTPQKLFVANYSQNVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1470 - protein, 747 aa, Artificial Sequence
  derived and/or modified protein sequence (wt) from MERS-CoV__AIY60558__S1
MIHSVFLLMFLLTPTESYVDVGPDSFKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1471 - protein, 747 aa, Artificial Sequence; identical to SEQ ID NO: 1448
  derived and/or modified protein sequence (wt) from MERS-CoV__AIZ74450__S1

SEQ ID NO: 1472 - protein, 747 aa, Artificial Sequence
  derived and/or modified protein sequence (wt) from MERS-CoV__AJD81440__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIINPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1473 - protein, 747 aa, Artificial Sequence; identical to SEQ ID NO: 1448
  derived and/or modified protein sequence (wt) from MERS-CoV__AKI29284__S1

SEQ ID NO: 1474 - protein, 747 aa, Artificial Sequence
  derived and/or modified protein sequence (wt) from MERS-CoV__AKL59401__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTRATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSILPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1475 - protein, 747 aa, Artificial Sequence
  derived and/or modified protein sequence (wt) from MERS-CoV__AKM76229__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTP

SEQ ID NO: 1476 - protein, 747 aa, Artificial Sequence
  derived and/or modified protein sequence (wt) from MERS-CoV__AKM76239__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTELPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1477 - protein, 747 aa, Artificial Sequence
  derived and/or modified protein sequence (wt) from MERS-CoV__AKN11072__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSTVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1478 - protein, 747 aa, Artificial Sequence
  derived and/or modified protein sequence (wt) from MERS-CoV__AKN11074__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSTVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQHFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1479 - protein, 747 aa, Artificial Sequence
  derived and/or modified protein sequence (wt) from MERS-CoV__AKN24803__S1
MVHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVSPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1480 - protein, 747 aa, Artificial Sequence
  derived and/or modified protein sequence (wt) from MERS-CoV__AKN24812__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFCVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1481 - protein, 747 aa, Artificial Sequence
  derived and/or modified protein sequence (wt) from MERS-CoV__AKN24830__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGPTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1482 - protein, 747 aa, Artificial Sequence; identical to SEQ ID NO: 1448
  derived and/or modified protein sequence (wt) from MERS-CoV__ALB08257__S1

SEQ ID NO: 1483 - protein, 747 aa, Artificial Sequence
  derived and/or modified protein sequence (wt) from MERS-CoV__ALB08311__S1
MIHSVFLLMFLLTPTESYVDVGPDSVKSACIEVDIQQTFFDKTWPRPIDVSKADGIIYPQGRTYSNITITYQGLFPYQGDHGDMYVYSAGYATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1484 - protein, 747 aa, Artificial Sequence; identical to SEQ ID NO: 1483
  derived and/or modified protein sequence (wt) from MERS-CoV__ALB08322__S1

SEQ ID NO: 1485 - protein, 747 aa, Artificial Sequence; identical to SEQ ID NO: 1448
  derived and/or modified protein sequence (wt) from MERS-CoV__ALD51904__S1

SEQ ID NO: 1486 - protein, 747 aa, Artificial Sequence
  derived and/or modified protein sequence (wt) from MERS-CoV__ALJ54446__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNFYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1487 - protein, 747 aa, Artificial Sequence
  derived and/or modified protein sequence (wt) from MERS-CoV__ALJ54448__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNAILNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1488 - protein, 747 aa, Artificial Sequence
  derived and/or modified protein sequence (wt) from MERS-CoV__ALJ54450__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRYASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1489 - protein, 747 aa, Artificial Sequence
  derived and/or modified protein sequence (wt) from MERS-CoV__ALJ54453__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1490 - protein, 747 aa, Artificial Sequence
  derived and/or modified protein sequence (wt) from MERS-CoV__ALJ54455__S1
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSKLKRRDSTYGPLQTPVGCVLGLVNSSLFVEDCKLPLGQSLCALPDTPSTLKP

SEQ ID NO: 1491 - protein, 747 aa, Artificial Sequence
  derived and/or modified protein sequence (wt) from MERS-CoV__ALJ54456__S1
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLKP

SEQ ID NO: 1492 - protein, 747 aa, Artificial Sequence
  derived and/or modified protein sequence (wt) from MERS-CoV__ALJ54461__S1
MIHSVFLLMFLLTPTESYVDVGPDSVKPACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVTSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTSVGCVLGLVNSSLFVEDCKLPLGQSLCALPDTPSTLTP

SEQ ID NO: 1493 - protein, 747 aa, Artificial Sequence
  derived and/or modified protein sequence (wt) from MERS-CoV__ALJ54468__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1494 - protein, 747 aa, Artificial Sequence
  derived and/or modified protein sequence (wt) from MERS-CoV__ALJ54471__S1
MIHSVYLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1495 - protein, 747 aa, Artificial Sequence
  derived and/or modified protein sequence (wt) from MERS-CoV__ALJ54472__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVLQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLAP

SEQ ID NO: 1496 - protein, 747 aa, Artificial Sequence
  derived and/or modified protein sequence (wt) from MERS-CoV__ALJ54474__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPSTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1497 - protein, 747 aa, Artificial Sequence
  derived and/or modified protein sequence (wt) from MERS-CoV__ALJ54483__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPIFQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1498 - protein, 747 aa, Artificial Sequence
  derived and/or modified protein sequence (wt) from MERS-CoV__ALJ54486__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRYASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVVSGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1499 - protein, 747 aa, Artificial Sequence
  derived and/or modified protein sequence (wt) from MERS-CoV__ALJ54488__S1
MIHSVFLLMFLLTPTESYVDVGPDSVKSACIEVDIQQTFFDKTWPRPIDVSKADGIIYPQGRTYSNITITYQGLFPYQGDHGDIYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1500 - protein, 747 aa, Artificial Sequence
  derived and/or modified protein sequence (wt) from MERS-CoV__ALJ54490__S1
MIHSVFLLMFLLTPTESYVDVGPDSVKSACIAVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLKP

SEQ ID NO: 1501 - protein, 747 aa, Artificial Sequence
  derived and/or modified protein sequence (wt) from MERS-CoV__ALJ54495__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVVSGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1502 - protein, 747 aa, Artificial Sequence
  derived and/or modified protein sequence (wt) from MERS-CoV__ALJ54496__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLPSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1503 - protein, 747 aa, Artificial Sequence
  derived and/or modified protein sequence (wt) from MERS-CoV__ALJ54500__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSLLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1504 - protein, 747 aa, Artificial Sequence
  derived and/or modified protein sequence (wt) from MERS-CoV__ALJ54501__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTLWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1505 - protein, 747 aa, Artificial Sequence; identical to SEQ ID NO: 1448
  derived and/or modified protein sequence (wt) from MERS-CoV__ALJ54502__S1

SEQ ID NO: 1506 - protein, 747 aa, Artificial Sequence
  derived and/or modified protein sequence (wt) from MERS-CoV__ALJ54512__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGAHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1507 - protein, 747 aa, Artificial Sequence
  derived and/or modified protein sequence (wt) from MERS-CoV__ALJ54517__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGNYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1508 - protein, 747 aa, Artificial Sequence; identical to SEQ ID NO: 1502
  derived and/or modified protein sequence (wt) from MERS-CoV__ALJ54518__S1

SEQ ID NO: 1509 - protein, 747 aa, Artificial Sequence
  derived and/or modified protein sequence (wt) from MERS-CoV__ALW82691__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLRSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1510 - protein, 747 aa, Artificial Sequence
  derived and/or modified protein sequence (wt) from MERS-CoV__ALW82742__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIQKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1511 - protein, 747 aa, Artificial Sequence; identical to SEQ ID NO: 1496
  derived and/or modified protein sequence (wt) from MERS-CoV__ALW82753__S1

SEQ ID NO: 1512 - protein, 747 aa, Artificial Sequence
  derived and/or modified protein sequence (wt) from MERS-CoV__ALX27228__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWKDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVSCVLGLVNSSLFVEDCKLPLGQSLCALPDTPSTLTP

SEQ ID NO: 1513 - protein, 747 aa, Artificial Sequence; identical to SEQ ID NO: 1454
  derived and/or modified protein sequence (wt) from MERS-CoV__ALX27232__S1

SEQ ID NO: 1514 - protein, 747 aa, Artificial Sequence
  derived and/or modified protein sequence (wt) from MERS-CoV__AMQ48993__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSIVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1515 - protein, 747 aa, Artificial Sequence
  derived and/or modified protein sequence (wt) from MERS-CoV__AMW90844__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITFQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1516 - protein, 747 aa, Artificial Sequence; identical to SEQ ID NO: 1468
  derived and/or modified protein sequence (wt) from MERS-CoV__AMW90852__S1

SEQ ID NO: 1517 - protein, 747 aa, Artificial Sequence
  derived and/or modified protein sequence (wt) from MERS-CoV__AMW90853__S1
MIHSVFLLMFLLTPTESYVDVGSDSVKSACIEVDIQQTFFDKTWPRPIDVSKADGIIYPQGRTYSNITITYQGLFPYQGDHGDMYVYSAGYATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNFTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1518 - protein, 747 aa, Artificial Sequence
  derived and/or modified protein sequence (wt) from MERS-CoV__ANC28656__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1519 - protein, 747 aa, Artificial Sequence
  derived and/or modified protein sequence (wt) from MERS-CoV__ANC28678__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSICSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDGRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1520 - protein, 747 aa, Artificial Sequence
  derived and/or modified protein sequence (wt) from MERS-CoV__AHL18090__S1
MIHSVFLLMFLLTPTESYVDVGLDSAKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAISSNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKKTKTHATLFGSVACEHISSTMSQYSRSTRSTLKRRDSTYGPLQTPVGCVLGLVNSSLFVEDCKLPLGQSLCALPDTPSTLTP

SEQ ID NO: 1521 - protein, 747 aa, Artificial Sequence
  derived and/or modified protein sequence (wt) from MERS-CoV__AHX00731__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLGVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1522 - protein, 747 aa, Artificial Sequence
  derived and/or modified protein sequence (wt) from MERS-CoV__AHX71946__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSHTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1523 - protein, 747 aa, Artificial Sequence
  derived and/or modified protein sequence (wt) from MERS-CoV__AHY22545__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFNRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1524 - protein, 747 aa, Artificial Sequence
  derived and/or modified protein sequence (wt) from MERS-CoV__AHY22555__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNYTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWASFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNSNQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1525 - protein, 747 aa, Artificial Sequence
  derived and/or modified protein sequence (wt) from MERS-CoV__AHY22565__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSAIIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWASFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1526 - protein, 747 aa, Artificial Sequence
  derived and/or modified protein sequence (wt) from MERS-CoV__AJG44069__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPRKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTP

SEQ ID NO: 1527 - protein, 747 aa, Artificial Sequence
  derived and/or modified protein sequence (wt) from MERS-CoV__AJG44080__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIKSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSPLTP

SEQ ID NO: 1528 - protein, 747 aa, Artificial Sequence
  derived and/or modified protein sequence (wt) from MERS-CoV__AJG44102__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVSHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTISQYSRSTRSMLKRRDSTYGPLQTPVGCVLGLVNSSLFVEDCKLPLGQSLCALPDTPSTLTP

SEQ ID NO: 1529 - protein, 747 aa, Artificial Sequence
  derived and/or modified protein sequence (wt) from MERS-CoV__AJG44124__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMFQYSRSTRSMLKRRDSTYGPLQTPVGCVLGLVNSSLFVEDCKLPLGQSLCALPDTPSTLTP

SEQ ID NO: 1530 - protein, 747 aa, Artificial Sequence
  derived and/or modified protein sequence (wt) from MERS-CoV__ALL26396__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLSVEDCKLPLGQSLCALPDTPSTLTP

SEQ ID NO: 1531 - protein, 747 aa, Artificial Sequence
  derived and/or modified protein sequence (wt) from MERS-CoV__ALS20350__S1
MIHSVFLLMFLLTPTESYVDVGPDSAKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNYCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVTVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1532 - protein, 747 aa, Artificial Sequence; identical to SEQ ID NO: 1448
  derived and/or modified protein sequence (wt) from MERS-CoV__ALT66880__S1

SEQ ID NO: 1533 - protein, 747 aa, Artificial Sequence
  derived and/or modified protein sequence (wt) from MERS-CoV__ALA49341__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTLQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFICSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1534 - protein, 747 aa, Artificial Sequence
  derived and/or modified protein sequence (wt) from MERS-CoV__ALA49352__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYYTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1535 - protein, 747 aa, Artificial Sequence
  derived and/or modified protein sequence (wt) from MERS-CoV__ALA49363__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATFPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1536 - protein, 747 aa, Artificial Sequence; identical to SEQ ID NO: 1468
  derived and/or modified protein sequence (wt) from MERS-CoV__ALA49374__S1

SEQ ID NO: 1537 - protein, 747 aa, Artificial Sequence
  derived and/or modified protein sequence (wt) from MERS-CoV__ALA49396__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSSSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1538 - protein, 747 aa, Artificial Sequence
  derived and/or modified protein sequence (wt) from MERS-CoV__ALA49451__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCNLPLGQSLCALPDTPSTLTP

SEQ ID NO: 1539 - protein, 747 aa, Artificial Sequence
  derived and/or modified protein sequence (wt) from MERS-CoV__ALA49473__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPTTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1540 - protein, 747 aa, Artificial Sequence; identical to SEQ ID NO: 1448
  derived and/or modified protein sequence (wt) from MERS-CoV__ALA49583__S1

SEQ ID NO: 1541 - protein, 747 aa, Artificial Sequence
  derived and/or modified protein sequence (wt) from MERS-CoV__ALA49649__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPKKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAIPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYHNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1542 - protein, 747 aa, Artificial Sequence
  derived and/or modified protein sequence (wt) from MERS-CoV__ALA49660__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKFYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1543 - protein, 747 aa, Artificial Sequence
  derived and/or modified protein sequence (wt) from MERS-CoV__ALA49671__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATNCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1544 - protein, 747 aa, Artificial Sequence; identical to SEQ ID NO: 1448
  derived and/or modified protein sequence (wt) from MERS-CoV__ALA49682__S1

SEQ ID NO: 1545 - protein, 747 aa, Artificial Sequence
  derived and/or modified protein sequence (wt) from MERS-CoV__ALA49803__S1
MIHSVFLLMFLLTPTESYVDVGPDSVKSACIEVDIQQTFFDKTWPRPIDVSKADGIIYPQGRTYSNITITYQGLFPYQGDHGDRYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPSTDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1546 - protein, 747 aa, Artificial Sequence; identical to SEQ ID NO: 1537
  derived and/or modified protein sequence (wt) from MERS-CoV__ALA49836__S1

SEQ ID NO: 1547 - protein, 747 aa, Artificial Sequence; identical to SEQ ID NO: 1448
  derived and/or modified protein sequence (wt) from MERS-CoV__ALA49957__S1

SEQ ID NO: 1548 - protein, 747 aa, Artificial Sequence
  derived and/or modified protein sequence (wt) from MERS-CoV__ALA50067__S1
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSSGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 1549 - RNA, 2244 nt, Artificial Sequence
  derived and/or modified CDS sequence (wt) from MERS-CoV__AFS88936__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1550 - RNA, 2244 nt, Artificial Sequence
  derived and/or modified CDS sequence (wt) from MERS-CoV__AFY13307__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuaguaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucguuuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1551 - RNA, 2244 nt, Artificial Sequence
  derived and/or modified CDS sequence (wt) from MERS-CoV__AGH58717__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacagucacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucuuucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1552 - RNA, 2244 nt, Artificial Sequence
  derived and/or modified CDS sequence (wt) from MERS-CoV__AGN52936__S1
augauacacucaguguuucuacugauguucuuguuaacaccuacagaaaguuacguugauguagggccagauucuauuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucauacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1553 - RNA, 2244 nt, Artificial Sequence
  derived and/or modified CDS sequence (wt) from MERS-CoV__AGN70951__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguucgcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcauaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1554 - RNA, 2244 nt, Artificial Sequence
  derived and/or modified CDS sequence (wt) from MERS-CoV__AGV08408__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucuggugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1555 - RNA, 2244 nt, Artificial Sequence
  derived and/or modified CDS sequence (wt) from MERS-CoV__AGV08455__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucauaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1556 - RNA, 2244 nt, Artificial Sequence
  derived and/or modified CDS sequence (wt) from MERS-CoV__AGV08467__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1557 - RNA, 2244 nt, Artificial Sequence; identical to SEQ ID NO: 1553
  derived and/or modified CDS sequence (wt) from MERS-CoV__AGV08492__S1

SEQ ID NO: 1558 - RNA, 2244 nt, Artificial Sequence
  derived and/or modified CDS sequence (wt) from MERS-CoV__AGV08584__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugcgugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1559 - RNA, 2244 nt, Artificial Sequence
  derived and/or modified CDS sequence (wt) from MERS-CoV__AHB33326__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccuauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugacacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1560 - RNA, 2244 nt, Artificial Sequence
  derived and/or modified CDS sequence (wt) from MERS-CoV__AHC74088__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguuuugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1561 - RNA, 2244 nt, Artificial Sequence
  derived and/or modified CDS sequence (wt) from MERS-CoV__AHI48528__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguucgcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccaccagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagugacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1562 - RNA, 2244 nt, Artificial Sequence
  derived and/or modified CDS sequence (wt) from MERS-CoV__AHI48550__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1563 - RNA, 2244 nt, Artificial Sequence
  derived and/or modified CDS sequence (wt) from MERS-CoV__AHI48583__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuuuuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1564 - RNA, 2244 nt, Artificial Sequence
  derived and/or modified CDS sequence (wt) from MERS-CoV__AHI48605__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaauaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1565 - RNA, 2244 nt, Artificial Sequence; identical to SEQ ID NO: 1551
  derived and/or modified CDS sequence (wt) from MERS-CoV__AHY21469__S1

SEQ ID NO: 1566 - RNA, 2244 nt, Artificial Sequence
  derived and/or modified CDS sequence (wt) from MERS-CoV__AHZ64057__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuucucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1567 - RNA, 2244 nt, Artificial Sequence
  derived and/or modified CDS sequence (wt) from MERS-CoV__AID50418__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugcuaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauaugguccucuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1568 - RNA, 2244 nt, Artificial Sequence; identical to SEQ ID NO: 1562
  derived and/or modified CDS sequence (wt) from MERS-CoV__AID55068__S1

SEQ ID NO: 1569 - RNA, 2244 nt, Artificial Sequence
  derived and/or modified CDS sequence (wt) from MERS-CoV__AID55073__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1570 - RNA, 2244 nt, Artificial Sequence
  derived and/or modified CDS sequence (wt) from MERS-CoV__AIY60528__S1
augauacacucaguguuucuacugauguucuuguuaacaccuacagaaaguuacguugauguagggccagauucuuuuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucagaacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1571 - RNA, 2244 nt, Artificial Sequence
  derived and/or modified CDS sequence (wt) from MERS-CoV__AIY60558__S1
augauacacucaguguuucuacugauguucuuguuaacaccuacagaaaguuacguugauguagggccagauucuuuuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucacaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1572 - RNA, 2244 nt, Artificial Sequence
  derived and/or modified CDS sequence (wt) from MERS-CoV__AIZ74450__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugacacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1573 - RNA, 2244 nt, Artificial Sequence
  derived and/or modified CDS sequence (wt) from MERS-CoV__AJD81440__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuaacccaucuaccagcgcuacuauacgaaaaauuuacccugcuuuuaugcuggguucuucaguugguaauuucucagaugguaaaaugggccgcuucuucaaucauacucuaguccuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugcuaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauaugguccucuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1574 - RNA, 2244 nt, Artificial Sequence; identical to SEQ ID NO: 1562
  derived and/or modified CDS sequence (wt) from MERS-CoV__AKI29284__S1

SEQ ID NO: 1575 - RNA, 2244 nt, Artificial Sequence
  derived and/or modified CDS sequence (wt) from MERS-CoV__AKL59401__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuacccgcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauucucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1576 - RNA, 2244 nt, Artificial Sequence
  derived and/or modified CDS sequence (wt) from MERS-CoV__AKM76229__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccuuaa

SEQ ID NO: 1577 - RNA, 2244 nt, Artificial Sequence
  derived and/or modified CDS sequence (wt) from MERS-CoV__AKM76239__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucuaaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaauuaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1578 - RNA, 2244 nt, Artificial Sequence
  derived and/or modified CDS sequence (wt) from MERS-CoV__AKN11072__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccacugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1579 - RNA, 2244 nt, Artificial Sequence
  derived and/or modified CDS sequence (wt) from MERS-CoV__AKN11074__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccacugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcacuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1580 - RNA, 2244 nt, Artificial Sequence
  derived and/or modified CDS sequence (wt) from MERS-CoV__AKN24803__S1
augguacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuucccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1581 - RNA, 2244 nt, Artificial Sequence
  derived and/or modified CDS sequence (wt) from MERS-CoV__AKN24812__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucugcguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1582 - RNA, 2244 nt, Artificial Sequence
  derived and/or modified CDS sequence (wt) from MERS-CoV__AKN24830__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcccaacuguugccaugacugagcaauuacagaugggcuuugguauuacaguucaauaugguacagacaccaauaguguuugccccaagcuugaauuugcuaaugacacaaaaauugccucucaauuaggcaauugcguggaauacucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1583 - RNA, 2244 nt, Artificial Sequence
  derived and/or modified CDS sequence (wt) from MERS-CoV__ALB08257__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1584 - RNA, 2244 nt, Artificial Sequence
  derived and/or modified CDS sequence (wt) from MERS-CoV__ALB08311__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggauaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1585 - RNA, 2244 nt, Artificial Sequence; identical to SEQ ID NO: 1584
  derived and/or modified CDS sequence (wt) from MERS-CoV__ALB08322__S1

SEQ ID NO: 1586 - RNA, 2244 nt, Artificial Sequence
  derived and/or modified CDS sequence (wt) from MERS-CoV__ALD51904__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1587 - RNA, 2244 nt, Artificial Sequence
  derived and/or modified CDS sequence (wt) from MERS-CoV__ALJ54446__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuucuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccaccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucucuguucguagaggacugcaaguugccucucggucaaucucucugugcucuuccugacacaccuaguacucucacaccuuaa

SEQ ID NO: 1588 - RNA, 2244 nt, Artificial Sequence
  derived and/or modified CDS sequence (wt) from MERS-CoV__ALJ54448__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccauucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1589 - RNA, 2244 nt, Artificial Sequence
  derived and/or modified CDS sequence (wt) from MERS-CoV__ALJ54450__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguuaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1590 - RNA, 2244 nt, Artificial Sequence
  derived and/or modified CDS sequence (wt) from MERS-CoV__ALJ54453__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1591 - RNA, 2244 nt, Artificial Sequence
  derived and/or modified CDS sequence (wt) from MERS-CoV__ALJ54455__S1
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaagcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccuuaa

SEQ ID NO: 1592 - RNA, 2244 nt, Artificial Sequence
  derived and/or modified CDS sequence (wt) from MERS-CoV__ALJ54456__S1
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccuuaa

SEQ ID NO: 1593 - RNA, 2244 nt, Artificial Sequence
  derived and/or modified CDS sequence (wt) from MERS-CoV__ALJ54461__S1
augauacacucaguguuucuacugauguucuuguuaacaccuacagaaaguuacguugauguagggccagauucuguuaagccugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugccaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuacuucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugcaucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaucuguugguuguguccuaggacuuguuaauuccucuuuguucguagaggacugcaaguugccucucggucaaucucucugugcucuuccugacacaccuaguacucucacaccuuaa

SEQ ID NO: 1594 - RNA, 2244 nt, Artificial Sequence
  derived and/or modified CDS sequence (wt) from MERS-CoV__ALJ54468__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucucuguucguagaggacugcaaguugccucucggucaaucucucugugcucuuccugacacaccuaguacucucacaccuuaa

SEQ ID NO: 1595 - RNA, 2244 nt, Artificial Sequence
  derived and/or modified CDS sequence (wt) from MERS-CoV__ALJ54471__S1
augauacacucaguguaucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucucucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1596 - RNA, 2244 nt, Artificial Sequence
  derived and/or modified CDS sequence (wt) from MERS-CoV__ALJ54472__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucucuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucuacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucgcaccuuaa

SEQ ID NO: 1597 - RNA, 2244 nt, Artificial Sequence
  derived and/or modified CDS sequence (wt) from MERS-CoV__ALJ54474__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuucaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1598 - RNA, 2244 nt, Artificial Sequence
  derived and/or modified CDS sequence (wt) from MERS-CoV__ALJ54483__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauauuccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1599 - RNA, 2244 nt, Artificial Sequence
  derived and/or modified CDS sequence (wt) from MERS-CoV__ALJ54486__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuauucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguuaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguuguuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1600 - RNA, 2244 nt, Artificial Sequence
  derived and/or modified CDS sequence (wt) from MERS-CoV__ALJ54488__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauuuaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1601 - RNA, 2244 nt, Artificial Sequence
  derived and/or modified CDS sequence (wt) from MERS-CoV__ALJ54490__S1
augauacacucaguguuucuacugauguucuuguuaacaccuacagaaaguuacguugauguagggccagauucuguuaagucugcuuguauugcgguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucaaaccuuaa

SEQ ID NO: 1602 - RNA, 2244 nt, Artificial Sequence
  derived and/or modified CDS sequence (wt) from MERS-CoV__ALJ54495__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugccugauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguuguuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1603 - RNA, 2244 nt, Artificial Sequence
  derived and/or modified CDS sequence (wt) from MERS-CoV__ALJ54496__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuuccuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1604 - RNA, 2244 nt, Artificial Sequence
  derived and/or modified CDS sequence (wt) from MERS-CoV__ALJ54500__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucauaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucacuucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1605 - RNA, 2244 nt, Artificial Sequence
  derived and/or modified CDS sequence (wt) from MERS-CoV__ALJ54501__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacuuugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1606 - RNA, 2244 nt, Artificial Sequence
  derived and/or modified CDS sequence (wt) from MERS-CoV__ALJ54502__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacuguucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1607 - RNA, 2244 nt, Artificial Sequence
  derived and/or modified CDS sequence (wt) from MERS-CoV__ALJ54512__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaaggugcucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1608 - RNA, 2244 nt, Artificial Sequence
  derived and/or modified CDS sequence (wt) from MERS-CoV__ALJ54517__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacgguaauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1609 - RNA, 2244 nt, Artificial Sequence
  derived and/or modified CDS sequence (wt) from MERS-CoV__ALJ54518__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuuccuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1610 - RNA, 2244 nt, Artificial Sequence
  derived and/or modified CDS sequence (wt) from MERS-CoV__ALW82691__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucguucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1611 - RNA, 2244 nt, Artificial Sequence
  derived and/or modified CDS sequence (wt) from MERS-CoV__ALW82742__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacaaaaaauuuacccugcuuuuaugcuggguucuucaguugguaauuucucagaugguaaaaugggccgcuucuucaaucauacucuaguucuuuugccugauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1612 - RNA, 2244 nt, Artificial Sequence; identical to SEQ ID NO: 1597
  derived and/or modified CDS sequence (wt) from MERS-CoV__ALW82753__S1

SEQ ID NO: 1613 - RNA, 2244 nt, Artificial Sequence
  derived and/or modified CDS sequence (wt) from MERS-CoV__ALX27228__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacuguguggaaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguuaguuguguccuaggacuuguuaauuccucuuuguucguagaggacugcaaguugccucuuggucaaucucucugugcucuuccugacacaccuaguacucucacaccuuaa

SEQ ID NO: 1614 - RNA, 2244 nt, Artificial Sequence; identical to SEQ ID NO: 1555
  derived and/or modified CDS sequence (wt) from MERS-CoV__ALX27232__S1

SEQ ID NO: 1615 - RNA, 2244 nt, Artificial Sequence
  derived and/or modified CDS sequence (wt) from MERS-CoV__AMQ48993__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaauuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1616 - RNA, 2244 nt, Artificial Sequence
  derived and/or modified CDS sequence (wt) from MERS-CoV__AMW90844__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacauuucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1617 - RNA, 2244 nt, Artificial Sequence
  derived and/or modified CDS sequence (wt) from MERS-CoV__AMW90852__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggcguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1618 - RNA, 2244 nt, Artificial Sequence
  derived and/or modified CDS sequence (wt) from MERS-CoV__AMW90853__S1
augauacacucaguguuucuacugauguucuuguuaacaccuacagaaaguuacguugauguagggucagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggauaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1619 - RNA, 2244 nt, Artificial Sequence
  derived and/or modified CDS sequence (wt) from MERS-CoV__ANC28656__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1620 - RNA, 2244 nt, Artificial Sequence
  derived and/or modified CDS sequence (wt) from MERS-CoV__ANC28678__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauuuguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugauggucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccguggugucuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1621 - RNA, 2244 nt, Artificial Sequence
  derived and/or modified CDS sequence (wt) from MERS-CoV__AHL18090__S1
augauacacucaguguuucuacugauguucuuguuaacaccuacagaaaguuacguugauguagggcuagauucugcuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacuguaccuuuauguacacuuauaacauuaccgaagaugagauuuuagagugguuuggcauuacacaaacugcucaagguguucaccucuucucuucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuacauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuucacuuguagucaaauaucuccagcagcaauuucuaguaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugacaaaaaaacuaaaacccacgcuacucuauuugguaguguugcaugugaacacauuucuucuaccaugucucaauacucccguucuacgcgaucaacgcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1622 - RNA, 2244 nt, Artificial Sequence
  derived and/or modified CDS sequence (wt) from MERS-CoV__AHX00731__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucgguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1623 - RNA, 2244 nt, Artificial Sequence
  derived and/or modified CDS sequence (wt) from MERS-CoV__AHX71946__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauucccauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1624 - RNA, 2244 nt, Artificial Sequence
  derived and/or modified CDS sequence (wt) from MERS-CoV__AHY22545__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauucuacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaaucguuugguuuuuaccaauugcaauuauaaucuuaccaaauugcuuucacuuuuuucugugaaugauuuuacuuguagucaaauaucuccagcggcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaauaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1625 - RNA, 2244 nt, Artificial Sequence
  derived and/or modified CDS sequence (wt) from MERS-CoV__AHY22555__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaauuauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcuuccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacucuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1626 - RNA, 2244 nt, Artificial Sequence
  derived and/or modified CDS sequence (wt) from MERS-CoV__AHY22565__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuauuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacgguggcaauauguuucaauuugccaccuugccuguuuaugauacuauuaaguauuacucuaucauuccucacaguauucguucuauccaaagugauagaaaagcuugggcuuccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1627 - RNA, 2244 nt, Artificial Sequence
  derived and/or modified CDS sequence (wt) from MERS-CoV__AJG44069__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacgaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcuacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccuuaa

SEQ ID NO: 1628 - RNA, 2244 nt, Artificial Sequence
  derived and/or modified CDS sequence (wt) from MERS-CoV__AJG44080__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcuacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuaucaaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguccucuuacaccuuaa

SEQ ID NO: 1629 - RNA, 2244 nt, Artificial Sequence
  derived and/or modified CDS sequence (wt) from MERS-CoV__AJG44102__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuucucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccauuucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1630 - RNA, 2244 nt, Artificial Sequence
  derived and/or modified CDS sequence (wt) from MERS-CoV__AJG44124__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccauguuucaauacucccguucuacgcgaucaaugcuuaagcggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1631 - RNA, 2244 nt, Artificial Sequence
  derived and/or modified CDS sequence (wt) from MERS-CoV__ALL26396__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaagcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaacaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagacucuacauaugguccccuucagacaccuguugguuguguccuaggacuuguuaauuccucuuuguccguagaggacugcaaguugccucuuggucaaucucucugugcucuuccugacacaccuaguacucucacaccuuaa

SEQ ID NO: 1632 - RNA, 2244 nt, Artificial Sequence
  derived and/or modified CDS sequence (wt) from MERS-CoV__ALS20350__S1
augauacacucaguguuucuacugauguucuuguuaacaccuacagaaaguuacguugauguagggccagauucugcuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaauuauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuucacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuacuguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1633 - RNA, 2244 nt, Artificial Sequence
  derived and/or modified CDS sequence (wt) from MERS-CoV__ALT66880__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuacucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuacuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucuuacaccuuaa

SEQ ID NO: 1634 - RNA, 2244 nt, Artificial Sequence
  derived and/or modified CDS sequence (wt) from MERS-CoV__ALA49341__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacucuacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuuuaagcguuugguuuuuaccaauugcaauuauaaucuuaccaaauugcuuucacuuuuuucugugaaugauuuuauuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1635 - RNA, 2244 nt, Artificial Sequence
  derived and/or modified CDS sequence (wt) from MERS-CoV__ALA49352__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuauuacacuccugcaacagauuguucugauggcaauuacaaucguaaugccagucugaacucuuuuaaggaguauuuuaauuuacguaacugcaccuuuauguacacuuauaacauuacugaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1636 - RNA, 2244 nt, Artificial Sequence
  derived and/or modified CDS sequence (wt) from MERS-CoV__ALA49363__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuuuccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1637 - RNA, 2244 nt, Artificial Sequence
  derived and/or modified CDS sequence (wt) from MERS-CoV__ALA49374__S1
augauacacucaguguuucuacugauguucuuguuaacaccuacagaaaguuacguugauguagggccagauucuguuaagucugcuuguauugagguugauauacaacagaccuuuuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaauuuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1638 - RNA, 2244 nt, Artificial Sequence
  derived and/or modified CDS sequence (wt) from MERS-CoV__ALA49396__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccucuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1639 - RNA, 2244 nt, Artificial Sequence
  derived and/or modified CDS sequence (wt) from MERS-CoV__ALA49451__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaauuugccucuuggucaaucucucugugcucuuccugacacaccuaguacucucacaccuuaa

SEQ ID NO: 1640 - RNA, 2244 nt, Artificial Sequence
  derived and/or modified CDS sequence (wt) from MERS-CoV__ALA49473__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuacaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcucuuccugacacaccuaguacucucacaccuuaa

SEQ ID NO: 1641 - RNA, 2244 nt, Artificial Sequence; identical to SEQ ID NO: 1586
  derived and/or modified CDS sequence (wt) from MERS-CoV__ALA49583__S1

SEQ ID NO: 1642 - RNA, 2244 nt, Artificial Sequence
  derived and/or modified CDS sequence (wt) from MERS-CoV__ALA49649__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccaaaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaauaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccauaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1643 - RNA, 2244 nt, Artificial Sequence
  derived and/or modified CDS sequence (wt) from MERS-CoV__ALA49660__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaauuuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1644 - RNA, 2244 nt, Artificial Sequence
  derived and/or modified CDS sequence (wt) from MERS-CoV__ALA49671__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacaaauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1645 - RNA, 2244 nt, Artificial Sequence
  derived and/or modified CDS sequence (wt) from MERS-CoV__ALA49682__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1646 - RNA, 2244 nt, Artificial Sequence
  derived and/or modified CDS sequence (wt) from MERS-CoV__ALA49803__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauagguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccuucaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1647 - RNA, 2244 nt, Artificial Sequence; identical to SEQ ID NO: 1638
  derived and/or modified CDS sequence (wt) from MERS-CoV__ALA49836__S1

SEQ ID NO: 1648 - RNA, 2244 nt, Artificial Sequence
  derived and/or modified CDS sequence (wt) from MERS-CoV__ALA49957__S1
augauacacucaguguuucuacugauguucuuguuaacaccuacagaaaguuacguugauguagggccagauucuguuaagucugcuuguauugagguugauauacaacagacuuucuuugauaaaacuuggccuaggccaauugauguuucuaaggcugacgguauuauauacccucaaggccguacauauucuaacauaacuaucacuuaucaaggucuuuuucccuaucagggagaccauggugauauguaugucuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucugcugguccaauaucccaguuuaauuauaaacaguccuuuucuaaucccacauguuugauuuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacuguuugcgugcuuguguuaguguuccuguuucugucaucuaugauaaagaaacuaaaacccacgcuacucuauuugguaguguugcaugugaacacauuuccucuaccaugucucaauacucccguucuacgcgaucaaugcuuaaacggcgagauucuacauaugguccccuucagacaccuguugguuguguccuaggacuuguuaauuccucuuuguucguagaggacugcaaguugccucuuggucaaucucucugugcccuuccugacacaccuaguacucucacaccuuaa

SEQ ID NO: 1649 - RNA, 2244 nt, Artificial Sequence
  derived and/or modified CDS sequence (wt) from MERS-CoV__ALA50067__S1
augauacacucaguguuucuacugauguucuuguuaacaccuacagaaaguuacguugauguagggccagauucuguuaagucugcuuguauugagguugauauacaacagaccuucuuugauaaaacuuggccuaggccaauugauguuucuaaggcugacgguauuauauacccucaaggccguacauauucuaacauaacuaucacuuaucaaggucuuuuucccuaucagggagaccauggugauauguauguuuacucugcaggacaugcuacaggcacaacuccacaaaaguuguuuguagcuaacuauucucaggacgucaaacaguuugcuaauggguuugucguccguauaggagcagcugccaauuccacuggcacuguuauuauuagcccaucuaccagcgcuacuauacgaaaaauuuacccugcuuuuaugcuggguucuucaguugguaauuucucagaugguaaaaugggccgcuucuucaaucauacucuaguucuuuugcccgauggauguggcacuuuacuuagagcuuuuuauuguauucuagagccucgcucuggaaaucauuguccugcuggcaauuccuauacuucuuuugccacuuaucacacuccugcaacagauuguucugauggcaauuacaaucguaaugccagucugaacucuuuuaaggaguauuuuaauuuacguaacugcaccuuuauguacacuuauaacauuaccgaagaugagauuuuagagugguuuggcauuacacaaacugcucaagguguucaccucuucucaucucgguauguugauuuguacggcggcaauauguuucaauuugccaccuugccuguuuaugauacuauuaaguauuauucuaucauuccucacaguauucguucuauccaaagugauagaaaagcuugggcugccuucuacguauauaaacuucaaccguuaacuuuccuguuggauuuuucuguugaugguuauauacgcagagcuauagacugugguuuuaaugauuugucacaacuccacugcucauaugaauccuucgauguugaaucuggaguuuauucaguuucgucuuucgaagcaaaaccuucuggcucaguuguggaacaggcugaagguguugaaugugauuuuucaccucuucugucuggcacaccuccucagguuuauaauuucaagcguuugguuuuuaccaauugcaauuauaaucuuaccaaauugcuuucacuuuuuucugugaaugauuuuacuuguagucaaauaucuccagcagcaauugcuagcaacuguuauucuucacugauuuuggauuauuuuucauacccacuuaguaugaaauccgaucucaguguuaguucuucugguccaauaucccaguuuaauuauaaacaguccuuuucuaaucccacauguuugaucuuagcgacuguuccucauaaccuuacuacuauuacuaagccucuuaaguacagcuauauuaacaagugcucucgucuucuuucugaugaucguacugaaguaccucaguuagugaacgcuaaucaauacucacccuguguauccauugucccauccacugugugggaagacggugauuauuauaggaaacaacuaucuccacuugaaggugguggcuggcuuguugcuaguggcucaacuguugccaugacugagcaauuacagaugggcuuugguauuacaguucaauaugguacagacaccaauaguguuugccccaagcuugaauuugcuaaugacacaaaaauugccucucaauuaggcaauugcguggaauauucccucuaugguguuucgggccgugguguuuuucagaauugcacagcuguagguguucgacagcagcgcuuuguuuaugaugcguaccagaauuuaguuggcuauuauucugaugauggcaacuacuacugucugcgugcuuguguuaguguuccuguuucugucaucuaugauaaagaaacuaaaacccacgcuacucuauuugguaguguugcaugugaacacauuucuucuaccaugucucaauacucccguucuacgcgaucaaugcuuaaacggcgagauucuacauauggcccccuucagacaccuguugguuguguccuaggacuuguuaauuccucuuuguucguagaggacugcaaguugccucucggucaaucucucugugcucuuccugacacaccuaguacucucacaccuuaa

SEQ ID NO: 1650 - RNA, 2244 nt, Artificial Sequence
  derived and/or modified CDS sequence (opt1) from MERS-CoV__AFS88936__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1651 - RNA, 2244 nt, Artificial Sequence
  derived and/or modified CDS sequence (opt1) from MERS-CoV__AFY13307__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgguuccucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgcccuga

SEQ ID NO: 1652 - RNA, 2244 nt, Artificial Sequence
  derived and/or modified CDS sequence (opt1) from MERS-CoV__AGH58717__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccgucaccacgccccagaagcuguucguggccaacuacucccaggacgugaagcaguucgccaacggcuucgucgugcgcaucggggccgcggccaacagcaccggcaccgugaucaucucccccagcaccuccgccaccauccggaagaucuaccccgccuucaugcuggggagcuccgucggcaacuucagcgacgggaagaugggccgcuucuucaaccacacgcucgugcugcugccggacggcugcgggacccuccugcgggcguucuacugcauccuggagccccgcuccggcaacuacugccccgccgggaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucggcaucacccagaccgcgcagggggugcaccucuucagcucccgguacgucgaccuguacggcgggaacauguuccaguucgccacccugccgguguacgacacgaucaaguacuacagcaucaucccccacuccauccucagcauccaguccgaccgcaaggccugggccgccuucuacguguacaagcugcagccccugaccuuccuccuggacuucagcgucgacggcuacauccggcgcgcgaucgacugcggguucaacgaccugucccagcuccacugcagcuacgaguccuucgacguggagagcggcguguacuccgucagcuccuucgaggccaagcccagcggcuccgugguggagcaggccgagggggucgagugcgacuucagcccgcugcuguccggcaccccgccccagguguacaacuucaagcggcucgucuucaccaacugcaacuacaaccugacgaagcugcucagccuguucuccgugaacgacuucacgugcagccagaucagccccgccgccaucgcguccaacugcuacagcucccugauccucgacuacuucagcuacccccuguccaugaaguccgaccugagcgugagcuccgccgggcccaucagccaguucaacuacaagcaguccuucagcaacccgaccugccucauccuggccaccgucccccacaaccugaccaccaucaccaagccccucaaguacuccuacaucaacaagugcagccgccugcuguccgacgaccggaccgaggugccccagcucgugaacgccaaccaguacagccccugcgucuccaucgugcccagcacggugugggaggacggggacuacuaccgcaagcagcugagcccgcuggagggcgggggcuggcucgucgccuccgggagcaccguggcgaugaccgagcagcugcagaugggcuucgggaucaccgugcaguacggcaccgacacgaacuccgucugccccaagcuggaguucgccaacgacaccaagaucgccagccagcucgggaacugcguggaguacucccuguacggcgugagcggccgcggggucuuccagaacugcaccgccgugggcgugcggcagcagcgguucgucuacgacgcguaccagaaccuggugggguacuacuccgacgacggcaacuacuacugccugcgcgccugcgugagcguccccguguccgugaucuacgacaaggagaccaagacgcacgccacccucuucggcagcgucgccugcgagcacaucuccagcaccaugucccaguacagccgguccacccgcagcaugcugaagcgccgggacuccacguacgggccgcugcagacccccgugggcugcgugcucgggcuggucaacagcucccuguucguggaggacugcaagcucccccugggccagagccugugcgcccuccccgacaccccgagcacccugacgcccuga

SEQ ID NO: 1653 - RNA, 2244 nt, Artificial Sequence
  derived and/or modified CDS sequence (opt1) from MERS-CoV__AGN52936__S1
augauccacagcguguuccugcucauguuccugcugacccccaccgaguccuacgucgacgugggcccggacagcaucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccaggacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgcccuga

SEQ ID NO: 1654 - RNA, 2244 nt, Artificial Sequence; identical to SEQ ID NO: 1650
  derived and/or modified CDS sequence (opt1) from MERS-CoV__AGN70951__S1

SEQ ID NO: 1655 - RNA, 2244 nt, Artificial Sequence
  derived and/or modified CDS sequence (opt1) from MERS-CoV__AGV08408__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccggggaccgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgcccuga

SEQ ID NO: 1656 - RNA, 2244 nt, Artificial Sequence
  derived and/or modified CDS sequence (opt1) from MERS-CoV__AGV08455__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcuacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1657 - RNA, 2244 nt, Artificial Sequence; identical to SEQ ID NO: 1650
  derived and/or modified CDS sequence (opt1) from MERS-CoV__AGV08467__S1

SEQ ID NO: 1658 - RNA, 2244 nt, Artificial Sequence; identical to SEQ ID NO: 1650
  derived and/or modified CDS sequence (opt1) from MERS-CoV__AGV08492__S1

SEQ ID NO: 1659 - RNA, 2244 nt, Artificial Sequence
  derived and/or modified CDS sequence (opt1) from MERS-CoV__AGV08584__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggccugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcgcugcccgacaccccgagcacccucacgcccuga

SEQ ID NO: 1660 - RNA, 2244 nt, Artificial Sequence
  derived and/or modified CDS sequence (opt1) from MERS-CoV__AHB33326__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccuacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1661 - RNA, 2244 nt, Artificial Sequence
  derived and/or modified CDS sequence (opt1) from MERS-CoV__AHC74088__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuucgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1662 - RNA, 2244 nt, Artificial Sequence
  derived and/or modified CDS sequence (opt1) from MERS-CoV__AHI48528__S1
augauccacagcguguuccugcucauguuccugcugacccccaccgaguccuacgucgacgugggccccgacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagcccgcccgccaucgccuccaacugcuacagcucccugauccuggacuacuucagcuacccccucuccaugaaguccgaccugagcgugagcuccgcggggcccaucagccaguucaacuacaagcaguccuucagcaacccgaccugccugauccucgugaccgucccccacaaccugaccaccaucaccaagccccugaaguacuccuacaucaacaagugcagccggcuccuguccgacgaccgcaccgaggugccccagcuggugaacgccaaccaguacagccccugcgucuccaucgugccgagcacggugugggaggacggggacuacuaccggaagcagcucagcccccuggagggcggcggguggcuggucgccuccggcagcaccguggccaugaccgagcagcuccagaugggguucggcaucaccgugcaguacgggaccgacacgaacuccgucugccccaagcuggaguucgccaacgacaccaagaucgcgagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggccugcgugagcgucccgguguccgugaucuacgacaaggagaccaagacgcacgcgacccuguucgggagcgucgccugcgagcacaucuccagcaccaugucccaguacagccgcuccacccgcagcaugcucaagcggcgcgacuccacguacggcccccugcagacccccguggggugcgugcugggccucgucaacagcucccuguucguggaggacugcaagcugccccucgggcagagccugugcgcccugccggacacccccagcacccucacgcccuga

SEQ ID NO: 1663 - RNA, 2244 nt, Artificial Sequence; identical to SEQ ID NO: 1650
  derived and/or modified CDS sequence (opt1) from MERS-CoV__AHI48550__S1

SEQ ID NO: 1664 - RNA, 2244 nt, Artificial Sequence
  derived and/or modified CDS sequence (opt1) from MERS-CoV__AHI48583__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguguucaaggccgacgggaucaucuacccccagggccggaccuacagcaacaucaccaucacguaccagggccucuucccguaccagggcgaccacggggacauguacguguacuccgcgggccacgccaccggcaccacgccccagaagcuguucgucgccaacuacagccaggacgugaagcaguucgccaacggguucgugguccgcaucggcgccgcggccaacuccaccgggaccgugaucaucagccccuccaccagcgccaccauccggaagaucuaccccgccuucaugcugggcuccagcguggggaacuucuccgacggcaagaugggccgcuucuucaaccacacgcucguccugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1665 - RNA, 2244 nt, Artificial Sequence; identical to SEQ ID NO: 1650
  derived and/or modified CDS sequence (opt1) from MERS-CoV__AHI48605__S1

SEQ ID NO: 1666 - RNA, 2244 nt, Artificial Sequence; identical to SEQ ID NO: 1652
  derived and/or modified CDS sequence (opt1) from MERS-CoV__AHY21469__S1

SEQ ID NO: 1667 - RNA, 2244 nt, Artificial Sequence
  derived and/or modified CDS sequence (opt1) from MERS-CoV__AHZ64057__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuucuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1668 - RNA, 2244 nt, Artificial Sequence; identical to SEQ ID NO: 1650
  derived and/or modified CDS sequence (opt1) from MERS-CoV__AID50418__S1

SEQ ID NO: 1669 - RNA, 2244 nt, Artificial Sequence; identical to SEQ ID NO: 1650
  derived and/or modified CDS sequence (opt1) from MERS-CoV__AID55068__S1

SEQ ID NO: 1670 - RNA, 2244 nt, Artificial Sequence
  derived and/or modified CDS sequence (opt1) from MERS-CoV__AID55073__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgcccuga

SEQ ID NO: 1671 - RNA, 2244 nt, Artificial Sequence
  derived and/or modified CDS sequence (opt1) from MERS-CoV__AIY60528__S1
augauccacagcguguuccugcucauguuccugcugacccccaccgaguccuacgucgacgugggcccggacagcuucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccagaacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgcccuga

SEQ ID NO: 1672 - RNA, 2244 nt, Artificial Sequence
  derived and/or modified CDS sequence (opt1) from MERS-CoV__AIY60558__S1
augauccacagcguguuccugcucauguuccugcugacccccaccgaguccuacgucgacgugggcccggacagcuucaaguccgccugcaucgagguggacauccagcagacguucuucgacaagaccuggccccgccccaucgacgucagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguggccaacuacucccaggacgucaagcaguucgccaacggguucguggugcgcaucggcgccgcggccaacagcaccgggaccgucaucaucucccccagcaccuccgccaccauccggaagaucuaccccgccuucaugcugggcagcuccguggggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgccuucuacgucuacaagcuccagccccugaccuuccugcucgacuucagcguggacggguacauccgccgggcgaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgccaucgcguccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggccuccggcagcaccguggcgaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgcccuga

SEQ ID NO: 1673 - RNA, 2244 nt, Artificial Sequence; identical to SEQ ID NO: 1650
  derived and/or modified CDS sequence (opt1) from MERS-CoV__AIZ74450__S1

SEQ ID NO: 1674 - RNA, 2244 nt, Artificial Sequence
  derived and/or modified CDS sequence (opt1) from MERS-CoV__AJD81440__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucaaccccuccaccagcgccaccauccggaagaucuaccccgccuucaugcugggcuccagcguggggaacuucuccgacggcaagaugggccgcuucuucaaccacacgcucguccugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1675 - RNA, 2244 nt, Artificial Sequence; identical to SEQ ID NO: 1650
  derived and/or modified CDS sequence (opt1) from MERS-CoV__AKI29284__S1

SEQ ID NO: 1676 - RNA, 2244 nt, Artificial Sequence
  derived and/or modified CDS sequence (opt1) from MERS-CoV__AKL59401__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcacccgggccaccauccgcaagaucuaccccgccuucaugcugggcuccagcguggggaacuucuccgacggcaagaugggccgguucuucaaccacacgcucguccugcugccggacgggugcggcacccuccugcgcgcguucuacugcauccuggagccccggagcgggaaccacugccccgccggcaacuccuacaccagcuucgccaccuaccacacgcccgccaccgacugcuccgacggcaacuacaaccgcaacgccagccucaacuccuucaaggaguacuucaaccugcggaacugcaccuucauguacaccuacaacaucacggaggacgagauccuggagugguucgggaucacccagaccgcgcagggcgugcaccucuucagcagccgcuacguggaccuguacgggggcaacauguuccaguucgccacccugccggucuacgacacgaucaaguacuacuccaucaucccccacagcauccgguccauccagagcgaccgcaaggccugggccgccuucuacguguacaagcuccagccccugaccuuccugcucgacuucuccguggacggguacauccggcgcgcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcggcugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccggccccaucucccaguucaacuacaagcagagcuucuccaacccgaccugccugauccucgccaccgugccccacaaccugaccaccaucaccaagccccugaaguacagcuacaucaacaagugcucccgccuccugagcgacgaccggaccgaggucccccagcuggugaacgccaaccaguacucccccugcgugagcauccuccccuccacggucugggaggacggggacuacuaccgcaagcagcugagcccgcuggagggcggcggguggcucguggccagcggcuccaccguggcgaugaccgagcagcugcagaugggguucggcaucaccguccaguacgggaccgacacgaacagcgugugccccaagcuggaguucgccaacgacaccaagaucgccucccagcucggcaacugcguggaguacagccuguacggcgucuccgggcggggcguguuccagaacugcaccgccguggggguccgccagcagcgguucguguacgacgcguaccagaaccuggugggcuacuacagcgacgacggcaacuacuacugccugcgcgccugcgucuccgugcccgugagcgucaucuacgacaaggagaccaagacgcacgccacccucuucggguccguggccugcgagcacaucagcuccaccaugagccaguacucccgcagcacccgguccaugcugaagcgccgggacagcacguacggcccgcugcagacccccguggggugcguccucggccuggugaacuccagccuguucguggaggacugcaagcucccccuggggcagucccugugcgcccuccccgacaccccgagcacccugacgcccuga

SEQ ID NO: 1677 - RNA, 2244 nt, Artificial Sequence
  derived and/or modified CDS sequence (opt1) from MERS-CoV__AKM76229__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcccccucacgcccuga

SEQ ID NO: 1678 - RNA, 2244 nt, Artificial Sequence
  derived and/or modified CDS sequence (opt1) from MERS-CoV__AKM76239__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgagcugccccagcucgucaacgccaaccaguacagccccugcguguccaucgugcccagcacggucugggaggacggggacuacuaccggaagcagcugagcccgcuggagggcggcggguggcucguggccuccggcagcaccguggcgaugaccgagcagcugcagaugggguucggcaucaccguccaguacgggaccgacacgaacuccgugugccccaagcuggaguucgccaacgacaccaagaucgccagccagcucggcaacugcguggaguacucccuguacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggggugcguccucggccuggugaacagcucccuguucguggaggacugcaagcucccccuggggcagagccugugcgcccuccccgacaccccgagcacccugacgcccuga

SEQ ID NO: 1679 - RNA, 2244 nt, Artificial Sequence
  derived and/or modified CDS sequence (opt1) from MERS-CoV__AKN11072__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccacgguccccagcaccgugugggaggacggggacuacuaccggaagcagcucagcccgcuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccgcugcagacccccgucgggugcgugcugggccucgugaacagcucccuguucgucgaggacugcaagcugccccucgggcagagccugugcgcccugcccgacaccccgagcacgcucacgcccuga

SEQ ID NO: 1680 - RNA, 2244 nt, Artificial Sequence
  derived and/or modified CDS sequence (opt1) from MERS-CoV__AKN11074__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccacgguccccagcaccgugugggaggacggggacuacuaccggaagcagcucagcccgcuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcacuucguguacgacgcguaccagaaccuggucggcuacuacuccgacgacggcaacuacuacugccugcgcgccugcgugagcgugcccgucuccgugaucuacgacaaggagacgaagacccacgccacccuguucgggagcguggccugcgagcacaucuccagcaccaugucccaguacagccgguccacgcgcagcaugcucaagcgccgggacuccaccuacggcccgcugcagacccccgucgggugcgugcugggccucgugaacagcucccuguucgucgaggacugcaagcugccccucgggcagagccugugcgcccugcccgacaccccgagcacgcucacgcccuga

SEQ ID NO: 1681 - RNA, 2244 nt, Artificial Sequence
  derived and/or modified CDS sequence (opt1) from MERS-CoV__AKN24803__S1
auggugcacagcgucuuccugcucauguuccugcugacccccaccgaguccuacguggacgugggcccggacagcgucaaguccgccugcaucgagguggacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacgucuacagcgcgggccacgccaccggcaccacgccccagaagcuguucguggccaacuacucccaggacgugaagcaguucgccaacggguucgucgugcgcaucggcgccgcggccaacagcaccgggaccgugaucaucucccccagcaccuccgccaccauccggaagaucuaccccgccuucaugcugggcagcuccgucgggaacuucagcgacggcaagaugggccgcuucuucaaccacacgcucgugcugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacgucgaccuguacgggggcaacauguuccaguucgccacccugccgguguacgacacgaucaaguacuacagcaucaucccccacuccauccgcagcauccaguccgaccggaaggccugggccgccuucuacguguacaagcuccagccccugaccuuccugcucgacuucagcgucgacggguacauccgccgggcgaucgacugcggcuucaacgaccugucccagcugcacugcagcuacgaguccuucgacguggagagcggcguguacuccgucagcuccuucgaggccaagcccagcggguccgugguggagcaggccgagggcgucgagugcgacuucagcccgcuccuguccgggaccccgccccagguguacaacuucaagcgccuggucuucaccaacugcaacuacaacuucacgaagcuccugagccuguucuccgugaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgucccccacaaccucaccaccaucaccaagccccugaaguacuccuacaucaacaagugcagccggcugcucuccgacgaccgcaccgaggugccccagcuggugaacgccaaccaguacagccccugcgucuccaucgugcccagcacggugugggaggacggggacuacuaccggaagcagcugagcccgcucgagggcggcggguggcuggucgccuccggcagcaccguggcgaugaccgagcagcugcagaugggguucggcaucaccgugcaguacgggaccgacacgaacuccgucagccccaagcucgaguucgccaacgacaccaagaucgccucccagcugggcaacugcguggaguacagccuguacggcguguccgggcgcggcgucuuccagaacugcaccgccgugggggugcggcagcagcgcuucgucuacgacgcguaccagaaccucgugggcuacuacagcgacgacggcaacuacuacugccugcgggccugcguguccguccccgugagcgugaucuacgacaaggagaccaagacgcacgccacccuguucggguccgucgccugcgagcacaucagcuccaccaugagccaguacucccgcagcacccgcuccaugcugaagcggcgcgacagcacguacggcccgcuccagacccccguggggugcgugcugggccuggucaacuccagccucuucguggaggacugcaagcugccccuggggcagagccucugcgcccugcccgacaccccguccacccugacgcccuga

SEQ ID NO: 1682 - RNA, 2244 nt, Artificial Sequence
  derived and/or modified CDS sequence (opt1) from MERS-CoV__AKN24812__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucugcguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccugagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgcccuga

SEQ ID NO: 1683 - RNA, 2244 nt, Artificial Sequence
  derived and/or modified CDS sequence (opt1) from MERS-CoV__AKN24830__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaacuucacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccgcugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggccccaccgucgcgaugaccgagcagcugcagaugggguucggcaucaccgugcaguacgggaccgacacgaacagcgugugccccaagcucgaguucgccaacgacaccaagaucgccucccagcugggcaacugcgucgaguacagccuguacggcguguccgggcgcggcguguuccagaacugcaccgccgucggggugcggcagcagcgcuucguguacgacgcguaccagaaccucgucggcuacuacagcgacgacggcaacuacuacugccugcgggccugcguguccgugccggucagcgugaucuacgacaaggagaccaagacgcacgccacccuguucggguccguggccugcgagcacaucagcuccaccaugagccaguacucccgcagcacccgcuccaugcugaagcggcgcgacagcacguacggcccccuccagacccccgucgggugcgugcugggccuggugaacuccagccucuucgucgaggacugcaagcugccccuggggcagucccucugcgcccugccggacacccccagcacccugacgcccuga

SEQ ID NO: 1684 - RNA, 2244 nt, Artificial Sequence; identical to SEQ ID NO: 1650
  derived and/or modified CDS sequence (opt1) from MERS-CoV__ALB08257__S1

SEQ ID NO: 1685 - RNA, 2244 nt, Artificial Sequence
  derived and/or modified CDS sequence (opt1) from MERS-CoV__ALB08311__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggcuacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgcccuga

SEQ ID NO: 1686 - RNA, 2244 nt, Artificial Sequence; identical to SEQ ID NO: 1685
  derived and/or modified CDS sequence (opt1) from MERS-CoV__ALB08322__S1

SEQ ID NO: 1687 - RNA, 2244 nt, Artificial Sequence; identical to SEQ ID NO: 1650
  derived and/or modified CDS sequence (opt1) from MERS-CoV__ALD51904__S1

SEQ ID NO: 1688 - RNA, 2244 nt, Artificial Sequence
  derived and/or modified CDS sequence (opt1) from MERS-CoV__ALJ54446__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacuucuacaccagcuucgccaccuaccacacgcccgccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucaucugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccacgaucaccaagccccugaaguacagcuacaucaacaagugcucccggcuccugagcgacgaccgcaccgaggucccccagcuggugaacgccaaccaguacucccccugcgugagcaucguccccuccaccgugugggaggacggggacuacuaccggaagcagcucagcccgcuggagggcggcggguggcugguggccagcggcuccacggucgcgaugaccgagcagcuccagaugggguucggcaucaccgugcaguacgggaccgacaccaacagcgugugccccaagcuggaguucgccaacgacacgaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacccacgccacgcuguucggguccguggccugcgagcacaucagcuccaccaugagccaguacucccgcagcacccgcuccaugcucaagcggcgcgacagcaccuacggcccgcugcagacgcccgucgggugcgugcugggccucgugaacuccagccuguucgucgaggacugcaagcugccccucgggcagucccugugcgcccugcccgacaccccgagcacccucacgcccuga

SEQ ID NO: 1689 - RNA, 2244 nt, Artificial Sequence
  derived and/or modified CDS sequence (opt1) from MERS-CoV__ALJ54448__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccauccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcguguccagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1690 - RNA, 2244 nt, Artificial Sequence
  derived and/or modified CDS sequence (opt1) from MERS-CoV__ALJ54450__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccgguacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1691 - RNA, 2244 nt, Artificial Sequence
  derived and/or modified CDS sequence (opt1) from MERS-CoV__ALJ54453__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaacuacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1692 - RNA, 2244 nt, Artificial Sequence
  derived and/or modified CDS sequence (opt1) from MERS-CoV__ALJ54455__S1
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggcguccggcagcaccgucgccaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgcggucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaagcucaagcggcgcgacuccacguacggcccgcugcagacccccgucgggugcgugcugggccucgugaacagcucccuguucgucgaggacugcaagcugccccucgggcagagccugugcgcgcugcccgacaccccgagcacccucaagcccuga

SEQ ID NO: 1693 - RNA, 2244 nt, Artificial Sequence
  derived and/or modified CDS sequence (opt1) from MERS-CoV__ALJ54456__S1
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggcguccggcagcaccgucgccaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgcggucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcgcugcccgacaccccgagcacccucaagcccuga

SEQ ID NO: 1694 - RNA, 2244 nt, Artificial Sequence
  derived and/or modified CDS sequence (opt1) from MERS-CoV__ALJ54461__S1
augauccacagcguguuccugcucauguuccugcugacccccaccgaguccuacgucgacgugggcccggacagcgugaagcccgccugcaucgaggucgacauccagcagacguucuucgacaagaccuggccccgccccaucgacguguccaaggccgacgggaucaucuacccgcagggccggaccuacagcaacaucaccaucacguaccagggccucuuccccuaccagggcgaccacggggacauguacguguacuccgcgggccacgccaccggcaccacgccccagaagcuguucgucgccaacuacagccaggacgugaagcaguucgccaacggguucgugguccgcaucggcgccgcggccaacuccaccgggaccgugaucaucagccccuccaccagcgccaccauccggaagaucuacccggccuucaugcugggcuccagcguggggaacuucuccgacggcaagaugggccgcuucuucaaccacacgcucguccugcugcccgacgggugcggcacccuccugcgggcguucuacugcauccuggagccccgcagcgggaaccacugccccgccggcaacuccuacaccagcuucgccaccuaccacacgccggccaccgacugcuccgacggcaacuacaaccggaacgccagccucaacuccuucaaggaguacuucaaccugcgcaacugcaccuucauguacaccuacaacaucacggaggacgagauccuggagugguucgggaucacccagaccgcgcagggcgugcaccucuucagcagccgguacguggaccuguacgggggcaacauguuccaguucgccacccugcccgucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagccguccgggagcgucguggagcaggccgagggcguggagugcgacuucagcccccuccuguccgggaccccgccccaggucuacaacuucaagcgccugguguucaccaacugcaacuacaaccucacgaagcugcugucccucuucagcgucaacgacuucacgugcucccagaucagccccgccgccaucgcgagcaacugcuacuccagccugauccuggacuacuucuccuacccccucagcaugaaguccgaccugagcgugaccuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcacggaggucccccagcuggugaacgccaaccaguacagccccugcguguccaucgucccgagcaccgugugggaggacggggacuacuaccggaagcagcucagcccccuggagggcggcggguggcugguggccuccggcagcaccgucgcgaugaccgagcagcuccagaugggguucggcaucaccgugcaguacgggacggacaccaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugccggucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccccugcagaccagcgucgggugcgugcugggccucgugaacuccagccuguucgucgaggacugcaagcugccccucgggcagucccugugcgcccugcccgacaccccgagcacgcucacgcccuga

SEQ ID NO: 1695 - RNA, 2244 nt, Artificial Sequence
  derived and/or modified CDS sequence (opt1) from MERS-CoV__ALJ54468__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucaucugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccacgaucaccaagccccugaaguacuccuacaucaacaagugcagccggcuccuguccgacgaccgcaccgaggucccccagcuggugaacgccaaccaguacagccccugcguguccaucguccccagcaccgugugggaggacggggacuacuaccggaagcagcucagcccgcuggagggcggcggguggcugguggccuccggcagcacggucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacgcuguucgggagcguggccugcgagcacaucuccagcaccaugucccaguacagccgcuccacccgcagcaugcucaagcggcgcgacuccaccuacggcccgcugcagacgcccgucgggugcgugcugggccucgugaacagcucccuguucgucgaggacugcaagcugccccucgggcagagccugugcgcccugcccgacaccccgagcacccucacgcccuga

SEQ ID NO: 1696 - RNA, 2244 nt, Artificial Sequence
  derived and/or modified CDS sequence (opt1) from MERS-CoV__ALJ54471__S1
augauccacagcguguaccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1697 - RNA, 2244 nt, Artificial Sequence
  derived and/or modified CDS sequence (opt1) from MERS-CoV__ALJ54472__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcugcagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccucuucgggagcguggccugcgagcacaucuccagcaccaugucccaguacagccgguccacccgcagcaugcugaagcgccgggacuccacguacggcccgcugcagacccccgucgggugcgugcucggccuggugaacagcucccuguucgucgaggacugcaagcucccccuggggcagagccugugcgcccuccccgacaccccgagcacccuggcgcccuga

SEQ ID NO: 1698 - RNA, 2244 nt, Artificial Sequence
  derived and/or modified CDS sequence (opt1) from MERS-CoV__ALJ54474__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccagcaccgacugcuccgacggcaacuacaaccggaacgccagccucaacagcuucaaggaguacuucaaccugcgcaacugcaccuucauguacaccuacaacaucacggaggacgagauccuggagugguucgggaucacccagaccgcccagggcgugcaccucuucuccagccgguacguggaccuguacgggggcaacauguuccaguucgcgacccugccggucuacgacacgaucaaguacuacuccaucaucccccacagcauccgcuccauccagagcgaccggaaggccugggccgccuucuacguguacaagcuccagccccugaccuuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgcccuga

SEQ ID NO: 1699 - RNA, 2244 nt, Artificial Sequence
  derived and/or modified CDS sequence (opt1) from MERS-CoV__ALJ54483__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucuuccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcagcucagcccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1700 - RNA, 2244 nt, Artificial Sequence
  derived and/or modified CDS sequence (opt1) from MERS-CoV__ALJ54486__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccgguacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggucuccggcagcaccguggccaugaccgagcagcuccagaugggguucggcaucaccgugcaguacgggaccgacacgaacuccgucugccccaagcuggaguucgcgaacgacaccaagaucgccagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggcgugcgugagcguccccguguccgugaucuacgacaaggagaccaagacgcacgccacccuguucgggagcgucgccugcgagcacaucuccagcaccaugucccaguacagccgcuccacccgcagcaugcucaagcggcgcgacuccacguacggcccgcugcagacccccguggggugcgugcugggccucgucaacagcucccuguucguggaggacugcaagcugccccucgggcagagccugugcgcccugcccgacaccccgagcacccucacgcccuga

SEQ ID NO: 1701 - RNA, 2244 nt, Artificial Sequence
  derived and/or modified CDS sequence (opt1) from MERS-CoV__ALJ54488__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacaucuacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1702 - RNA, 2244 nt, Artificial Sequence
  derived and/or modified CDS sequence (opt1) from MERS-CoV__ALJ54490__S1
augauccacagcguguuccugcucauguuccugcugacccccaccgaguccuacgucgacgugggcccggacagcgugaaguccgccugcaucgccgucgacauccagcagacguucuucgacaagaccuggccccgccccaucgacgugagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucgucgccaacuacucccaggacgugaagcaguucgccaacggguucgugguccgcaucggcgcggccgccaacagcaccgggaccgugaucaucucccccagcaccuccgccaccauccggaagaucuaccccgcguucaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgcguucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgcgaucgccuccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggcguccgggagcaccgucgccaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgcggucggcgugcggcagcagcgcuucguguacgacgccuaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcgcugcccgacaccccgagcacccucaagcccuga

SEQ ID NO: 1703 - RNA, 2244 nt, Artificial Sequence
  derived and/or modified CDS sequence (opt1) from MERS-CoV__ALJ54495__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggucuccggcagcaccguggccaugaccgagcagcuccagaugggguucggcaucaccgugcaguacgggaccgacacgaacuccgucugccccaagcuggaguucgcgaacgacaccaagaucgccagccagcugggcaacugcguggaguacucccucuacggcgugagcgggcgcggcgucuuccagaacugcaccgccgugggggugcggcagcagcgcuucgucuacgacgccuaccagaaccuggugggcuacuacuccgacgacggcaacuacuacugccugcgggcgugcgugagcguccccguguccgugaucuacgacaaggagaccaagacgcacgccacccuguucgggagcgucgccugcgagcacaucuccagcaccaugucccaguacagccgcuccacccgcagcaugcucaagcggcgcgacuccacguacggcccgcugcagacccccguggggugcgugcugggccucgucaacagcucccuguucguggaggacugcaagcugccccucgggcagagccugugcgcccugcccgacaccccgagcacccucacgcccuga

SEQ ID NO: 1704 - RNA, 2244 nt, Artificial Sequence
  derived and/or modified CDS sequence (opt1) from MERS-CoV__ALJ54496__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccccuccgacgaccgcaccgaggucccccagcuggugaacgccaaccaguacagccccugcguguccaucgucccgagcacggugugggaggacggggacuacuaccggaagcagcugagcccccucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugccggucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccccuccagacccccgucgggugcgugcugggccuggugaacagcucccucuucgucgaggacugcaagcugccccuggggcagagccucugcgcccugccggacacccccagcacccugacgcccuga

SEQ ID NO: 1705 - RNA, 2244 nt, Artificial Sequence
  derived and/or modified CDS sequence (opt1) from MERS-CoV__ALJ54500__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagccuccugcuguccgggaccccgccccaggucuacaacuucaagcgccucguguucaccaacugcaacuacaaccugacgaagcugcucagccuguucuccgucaacgacuucacgugcagccagaucagccccgccgccaucgcguccaacugcuacagcucccugauccucgacuacuucagcuacccccuguccaugaaguccgaccugagcgugagcuccgccggcccgaucagccaguucaacuacaagcaguccuucagcaacccgaccugccucauccuggccaccgugccccacaaccugaccaccaucaccaagccccucaaguacuccuacaucaacaagugcagccggcugcuguccgacgaccgcaccgaggucccccagcucgugaacgccaaccaguacagccccugcguguccaucguccccagcacggugugggaggacggggacuacuaccggaagcagcugagcccccuggagggcggcggguggcucguggccuccggcagcaccgucgcgaugaccgagcagcugcagaugggguucggcaucaccgugcaguacgggaccgacacgaacuccgugugcccgaagcuggaguucgccaacgacaccaagaucgccagccagcucggcaacugcgucgaguacucccuguacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccucuucgggagcguggccugcgagcacaucuccagcaccaugucccaguacagccgcuccacccgcagcaugcugaagcggcgcgacuccacguacggcccccugcagaccccggucgggugcgugcucggccuggugaacagcucccuguucgucgaggacugcaagcucccccuggggcagagccugugcgcccuccccgacacccccagcacccugacgccguga

SEQ ID NO: 1706 - RNA, 2244 nt, Artificial Sequence
  derived and/or modified CDS sequence (opt1) from MERS-CoV__ALJ54501__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacgcucugggaggacggggacuacuaccggaagcagcugagcccgcuggagggcggcggguggcucguggccuccggcagcaccguggcgaugaccgagcagcugcagaugggguucggcaucaccguccaguacgggaccgacacgaacuccgugugccccaagcuggaguucgccaacgacaccaagaucgccagccagcucggcaacugcguggaguacucccuguacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggggugcguccucggccuggugaacagcucccuguucguggaggacugcaagcucccccuggggcagagccugugcgcccuccccgacaccccgagcacccugacgcccuga

SEQ ID NO: 1707 - RNA, 2244 nt, Artificial Sequence; identical to SEQ ID NO: 1650
  derived and/or modified CDS sequence (opt1) from MERS-CoV__ALJ54502__S1

SEQ ID NO: 1708 - RNA, 2244 nt, Artificial Sequence
  derived and/or modified CDS sequence (opt1) from MERS-CoV__ALJ54512__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgcccaccucuucagcucccgguacguggaccuguacgggggcaacauguuccaguucgccacccugccgguguacgacacgaucaaguacuacagcaucaucccccacuccauccgcagcauccaguccgaccggaaggccugggccgcguucuacgucuacaagcuccagccccugaccuuccugcucgacuucagcguggacggguacauccgccgggccaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgcgaucgccuccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcgcugcccgacaccccgagcacccucacgcccuga

SEQ ID NO: 1709 - RNA, 2244 nt, Artificial Sequence
  derived and/or modified CDS sequence (opt1) from MERS-CoV__ALJ54517__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacgggaacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1710 - RNA, 2244 nt, Artificial Sequence; identical to SEQ ID NO: 1704
  derived and/or modified CDS sequence (opt1) from MERS-CoV__ALJ54518__S1

SEQ ID NO: 1711 - RNA, 2244 nt, Artificial Sequence
  derived and/or modified CDS sequence (opt1) from MERS-CoV__ALW82691__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccgcuccgacgaccggaccgaggucccccagcuggugaacgccaaccaguacagccccugcguguccaucguccccagcacggugugggaggacggggacuacuaccgcaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcggggcguguuccagaacugcaccgccgucggggugcgccagcagcgguucguguacgacgcguaccagaaccucgucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgcuccacccggagcaugcugaagcgccgggacuccacguacggcccgcuccagacccccgucgggugcgugcugggccuggugaacagcucccucuucgucgaggacugcaagcugccccuggggcagagccucugcgcccugcccgacaccccgagcacccugacgcccuga

SEQ ID NO: 1712 - RNA, 2244 nt, Artificial Sequence
  derived and/or modified CDS sequence (opt1) from MERS-CoV__ALW82742__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccagaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccgccaccgacugcagcgacggcaacuacaaccgcaacgccucccucaacagcuucaaggaguacuucaaccugcggaacugcaccuucauguacaccuacaacaucacggaggacgagauccuggagugguucgggaucacccagaccgcgcagggcgugcaccucuucagcucccgcuacguggaccuguacgggggcaacauguuccaguucgccacccugccggucuacgacacgaucaaguacuacagcaucaucccccacuccauccggagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgccuccuguccgacgaccggaccgaggucccccagcuggugaacgccaaccaguacagccccugcguguccaucguccccagcacggugugggaggacggggacuacuaccgcaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcggggcguguuccagaacugcaccgccgucggggugcgccagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgguccacccgcagcaugcucaagcgccgggacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1713 - RNA, 2244 nt, Artificial Sequence; identical to SEQ ID NO: 1698
  derived and/or modified CDS sequence (opt1) from MERS-CoV__ALW82753__S1

SEQ ID NO: 1714 - RNA, 2244 nt, Artificial Sequence
  derived and/or modified CDS sequence (opt1) from MERS-CoV__ALX27228__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacgguguggaaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucagcugcgugcuggggcucgugaacuccagccuguucgucgaggacugcaagcugccccucggccagagccugugcgcccugcccgacaccccguccacccucacgcccuga

SEQ ID NO: 1715 - RNA, 2244 nt, Artificial Sequence; identical to SEQ ID NO: 1656
  derived and/or modified CDS sequence (opt1) from MERS-CoV__ALX27232__S1

SEQ ID NO: 1716 - RNA, 2244 nt, Artificial Sequence
  derived and/or modified CDS sequence (opt1) from MERS-CoV__AMQ48993__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaucgucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacgcuguucgggagcguggccugcgagcacaucuccagcaccaugucccaguacagccgcuccacccgcagcaugcucaagcggcgcgacuccaccuacggcccgcugcagacgcccgucgggugcgugcugggccucgugaacagcucccuguucgucgaggacugcaagcugccccucgggcagagccugugcgcccugcccgacaccccgagcacccucacgcccuga

SEQ ID NO: 1717 - RNA, 2244 nt, Artificial Sequence
  derived and/or modified CDS sequence (opt1) from MERS-CoV__AMW90844__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccuuccaguacgggaccgacacgaacuccgugugccccaagcuggaguucgccaacgacaccaagaucgccagccagcugggcaacugcguggaguacucccucuacggcgucagcgggcgcggcguguuccagaacugcaccgccguggggguccggcagcagcgcuucguguacgacgcguaccagaaccuggugggcuacuacuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccguggggugcguccugggccucgugaacagcucccuguucguggaggacugcaagcugccccucgggcagagccugugcgcccugcccgacaccccgagcacccucacgcccuga

SEQ ID NO: 1718 - RNA, 2244 nt, Artificial Sequence; identical to SEQ ID NO: 1670
  derived and/or modified CDS sequence (opt1) from MERS-CoV__AMW90852__S1

SEQ ID NO: 1719 - RNA, 2244 nt, Artificial Sequence
  derived and/or modified CDS sequence (opt1) from MERS-CoV__AMW90853__S1
augauccacagcguguuccugcucauguuccugcugacccccaccgaguccuacgucgacgugggcagcgacuccgugaaguccgccugcaucgaggucgacauccagcagacguucuucgacaagaccuggccgcgccccaucgacguguccaaggccgacgggaucaucuacccccagggccggaccuacagcaacaucaccaucacguaccaggggcuguuccccuaccagggcgaccacggggacauguacguguacuccgcgggcuacgccaccggcaccaccccgcagaagcuguucgucgccaacuacagccaggacgugaagcaguucgccaacggguucgugguccgcaucggcgccgcggccaacuccacggggaccgugaucaucagccccuccaccagcgccaccauccggaagaucuaccccgccuucaugcugggcuccagcguggggaacuucuccgacggcaagaugggccgcuucuucaaccacacgcucguccugcugcccgacgggugcggcacccuccugcgggcguucuacugcauccuggagccgcgcagcgggaaccacugccccgccggcaacuccuacaccagcuucgccaccuaccacacgcccgccaccgacugcuccgacggcaacuacaaccggaacgccagccucaacagcuucaaggaguacuucaaccugcgcaacugcaccuucauguacaccuacaacaucacggaggacgagauccuggagugguucgggaucacccagaccgcgcagggcgugcaccucuucuccagccgguacguggaccuguacgggggcaacauguuccaguucgccacccugcccgucuacgacacgaucaaguacuacuccaucaucccgcacagcauccgcuccauccagagcgaccggaaggccugggccgccuucuacguguacaagcuccagccccugaccuuccugcucgacuucuccguggacggguacauccgccgggcgaucgacugcggcuucaacgaccugagccagcugcacugcuccuacgagagcuucgacgucgaguccggcguguacagcguguccagcuucgaggccaagcccuccgggagcgucguggagcaggccgagggcguggagugcgacuucagcccccuccugagcgggaccccgccccaggucuacaacuucaagcgccugguguucaccaacugcaacuacaacuucacgaagcuccugucccuguucagcgucaacgacuucacgugcagccagaucucccccgccgccaucgcgagcaacugcuacuccagccucauccuggacuacuucuccuacccccugagcaugaaguccgaccucagcguguccagcgccggcccgaucucccaguucaacuacaagcagagcuucuccaacccgaccugccugauccuggccaccgugccccacaaccucaccaccaucaccaagccccugaaguacagcuacaucaacaagugcucccggcugcucagcgacgaccgcaccgaggucccccagcuggugaacgccaaccaguacucccccugcgugagcaucguccccagcacggugugggaggacggggacuacuaccggaagcagcugagcccccucgagggcggcggguggcugguggccuccggcuccaccgucgcgaugaccgagcagcugcagaugggguucggcaucaccgugcaguacgggaccgacacgaacagcgugugcccgaagcucgaguucgccaacgacaccaagaucgccucccagcugggcaacugcgucgaguacagccuguacggcguguccgggcgcggcguguuccagaacugcaccgccgucggggugcggcagcagcgcuucguguacgacgcguaccagaaccucgucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcugaagcggcgcgacagcacguacggcccccuccagaccccggucgggugcgugcugggccuggugaacuccagccucuucgucgaggacugcaagcugccccuggggcagagccucugcgcccugcccgacacccccuccacccugacgccguga

SEQ ID NO: 1720 - RNA, 2244 nt, Artificial Sequence
  derived and/or modified CDS sequence (opt1) from MERS-CoV__ANC28656__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgggcgcaccgaggucccccagcuggugaacgccaaccaguacagccccugcguguccaucguccccagcacggugugggaggacggcgacuacuaccggaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgcuucguguacgacgcguaccagaaccuggucggcuacuacuccgacgacgggaacuacuacugccugcgggccugcgugagcgugcccgucuccgugaucuacgacaaggagaccaagacgcacgccacccuguucggcagcguggccugcgagcacaucuccagcaccaugucccaguacagccgcuccacccgcagcaugcucaagcggcgcgacuccacguacgggccgcugcagacccccgucggcugcgugcuggggcucgugaacagcucccuguucgucgaggacugcaagcugccccucggccagagccugugcgcccugcccgacaccccgagcacccucacgcccuga

SEQ ID NO: 1721 - RNA, 2244 nt, Artificial Sequence
  derived and/or modified CDS sequence (opt1) from MERS-CoV__ANC28678__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccaucugcagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccgccuccuguccgacgggcggaccgaggucccccagcuggugaacgccaaccaguacagccccugcguguccaucguccccagcacggugugggaggacggcgacuacuaccgcaagcagcucagcccgcuggagggcgggggcuggcugguggccuccgggagcaccgucgcgaugaccgagcagcuccagaugggcuucgggaucaccgugcaguacggcaccgacacgaacuccgugugccccaagcuggaguucgccaacgacaccaagaucgccagccagcugggcaacugcgucgaguacucccucuacggggugagcggccgcgggguguuccagaacugcaccgccgucggcgugcggcagcagcgguucguguacgacgcguaccagaaccuggucggcuacuacuccgacgacgggaacuacuacugccugcgcgccugcgugagcgugcccgucuccgugaucuacgacaaggagaccaagacgcacgccacccuguucggcagcguggccugcgagcacaucuccagcaccaugucccaguacagccgguccacccgcagcaugcucaagcgccgggacuccacguacgggccgcugcagacccccgucggcugcgugcuggggcucgugaacagcucccuguucgucgaggacugcaagcugccccucggccagagccugugcgcccugcccgacaccccgagcacccucacgcccuga

SEQ ID NO: 1722 - RNA, 2244 nt, Artificial Sequence
  derived and/or modified CDS sequence (opt1) from MERS-CoV__AHL18090__S1
augauccacagcguguuccugcucauguuccugcugacccccaccgaguccuacgucgacgugggccucgacagcgccaaguccgccugcaucgagguggacauccagcagacguucuucgacaagaccuggccgcgccccaucgacgucagcaaggcggacgggaucaucuacccccagggccggaccuacuccaacaucaccaucacguaccaggggcuguuccccuaccagggcgaccacggggacauguacguguacagcgccggccacgccaccggcaccaccccgcagaagcuguucguggccaacuacucccaggacgucaagcaguucgccaacggguucguggugcgcaucggcgcggccgccaacagcacggggaccgucaucaucucccccagcaccuccgccaccauccggaagaucuaccccgcguucaugcucggcagcuccguggggaacuucagcgacggcaagaugggccgcuucuucaaccacacgcuggugcugcuccccgacgggugcggcacccugcugcgggccuucuacugcauccucgagccgcgcuccgggaacuacugccccgccggcaacagcuacaccuccuucgccaccuaccacacgcccgccaccgacugcagcgacggcaacuacaaccggaacgcgucccugaacagcuucaaggaguacuucaaccugcgcaacugcaccuucauguacaccuacaacaucacggaggacgagauccucgagugguucgggaucacccagaccgcccagggcguccaccuguucagcucccgguacguggaccuguacgggggcaacauguuccaguucgccacccuccccguguacgacacgaucaaguacuacagcaucaucccgcacuccauccgcagcauccaguccgaccggaaggccugggccgcguucuacgucuacaagcugcagccccugaccuuccuccuggacuucagcguggacggguacauccgccgggccaucgacugcggcuucaacgaccugucccagcuccacugcagcuacgaguccuucgacguggagagcggcgucuacuccgugagcuccuucgaggccaagcccagcggguccguggucgagcaggccgagggcguggagugcgacuucagcccccugcuguccgggaccccgccccagguguacaacuucaagcgccucgucuucaccaacugcaacuacaaccugacgaagcugcucagccuguucuccgugaacgacuucacgugcagccagaucagccccgccgcgaucuccagcaacugcuacuccagccugauccucgacuacuucuccuacccccugagcaugaaguccgaccugagcgucuccagcgccggcccgaucucccaguucaacuacaagcagagcuucuccaacccgaccugccucauccuggccaccgugccccacaaccugaccaccaucaccaagccccucaaguacagcuacaucaacaagugcucccggcugcugagcgacgaccgcaccgaggugccccagcucgucaacgccaaccaguacucccccugcgugagcaucgugcccagcacggucugggaggacggggacuacuaccggaagcagcugagcccccuggagggcggcggguggcucguggccagcggcuccaccguggcgaugaccgagcagcugcagaugggguucggcaucaccguccaguacgggaccgacacgaacagcgugugcccgaagcuggaguucgccaacgacaccaagaucgccucccagcucggcaacugcguggaguacagccuguacggcgucuccgggcgcggcguguuccagaacugcaccgccguggggguccggcagcagcgcuucguguacgacgcguaccagaaccuggugggcuacuacagcgacgacggcaacuacuacugccugcgggccugcgucuccgugcccgugagcgucaucuacgacaagaagaccaagacgcacgccacccucuucggguccguggccugcgagcacaucagcuccaccaugagccaguacucccgcagcacccgcuccacgcugaagcggcgcgacagcaccuacggcccccugcagaccccgguggggugcguccucggccuggugaacuccagccuguucguggaggacugcaagcucccccuggggcagagccugugcgcccuccccgacacccccuccacgcugaccccguga

SEQ ID NO: 1723 - RNA, 2244 nt, Artificial Sequence
  derived and/or modified CDS sequence (opt1) from MERS-CoV__AHX00731__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugggggugagcagcgccgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccuccacggugugggaggacggcgacuacuaccggaagcagcucagcccgcuggagggcgggggcuggcugguggccagcggguccaccgucgcgaugaccgagcagcuccagaugggcuucgggaucaccgugcaguacggcaccgacacgaacagcgugugccccaagcuggaguucgccaacgacaccaagaucgccucccagcugggcaacugcgucgaguacagccucuacgggguguccggccgcgggguguuccagaacugcaccgccgucggcgugcggcagcagcgcuucguguacgacgcguaccagaaccuggucggcuacuacagcgacgacgggaacuacuacugccugcgggccugcguguccgugcccgucagcgugaucuacgacaaggagaccaagacgcacgccacccuguucggcuccguggccugcgagcacaucagcuccaccaugagccaguacucccgcagcacccgcuccaugcucaagcggcgcgacagcacguacgggccgcugcagacccccgucggcugcgugcuggggcucgugaacuccagccuguucgucgaggacugcaagcugccccucggccagucccugugcgcccugcccgacaccccgagcacccucacgcccuga

SEQ ID NO: 1724 - RNA, 2244 nt, Artificial Sequence
  derived and/or modified CDS sequence (opt1) from MERS-CoV__AHX71946__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagccacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1725 - RNA, 2244 nt, Artificial Sequence
  derived and/or modified CDS sequence (opt1) from MERS-CoV__AHY22545__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaaccgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1726 - RNA, 2244 nt, Artificial Sequence
  derived and/or modified CDS sequence (opt1) from MERS-CoV__AHY22555__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaacuacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccagcuucuacguguacaagcuccagccccugaccuuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacuccaaccaguacagccccugcgugagcaucguccccuccacggugugggaggacggggacuacuaccggaagcagcucagcccgcuggagggcggcggguggcugguggccuccggcagcaccgucgccaugaccgagcagcuccagaugggguucggcaucaccgugcaguacgggaccgacacgaacuccgugugccccaagcuggaguucgccaacgacaccaagaucgcgagccagcugggcaacugcgucgaguacucccucuacggcgugagcgggcgcggcguguuccagaacugcaccgccgucggggugcggcagcagcgcuucguguacgacgccuaccagaaccuggucggcuacuacuccgacgacggcaacuacuacugccugcgggccugcgugagcgugcccgucuccgugaucuacgacaaggagaccaagacgcacgcgacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcagccuguucgucgaggacugcaagcugccccucgggcagucccugugcgcccugcccgacaccccgagcacccucacgcccuga

SEQ ID NO: 1727 - RNA, 2244 nt, Artificial Sequence
  derived and/or modified CDS sequence (opt1) from MERS-CoV__AHY22565__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaucauccggaagaucuaccccgccuucaugcugggcagcuccguggggaacuucagcgacggcaagaugggccgcuucuucaaccacacccucguccugcugccggacgggugcggcacgcuccugcgggcguucuacugcauccuggagccccgcuccgggaaccacugccccgccggcaacagcuacaccuccuucgccaccuaccacacccccgccacggacugcagcgacggcaacuacaaccggaacgccucccucaacagcuucaaggaguacuucaaccugcgcaacugcaccuucauguacaccuacaacaucaccgaggacgagauccuggagugguucgggaucacgcagaccgcgcagggcgugcaccucuucagcucccgguacguggaccuguacgggggcaacauguuccaguucgccacccugccggucuacgacaccaucaaguacuacagcaucaucccccacuccauccgcagcauccaguccgaccggaaggccugggccagcuucuacguguacaagcuccagccccugacguuccugcucgacuucuccguggacggguacauccgccgggccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcgccugguguucaccaacugcaacuacaaccucaccaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccacgaucaccaagccccugaaguacagcuacaucaacaagugcucccggcuccugagcgacgaccgcaccgaggucccccagcuggugaacgccaaccaguacucccccugcgugagcaucguccccagcaccgugugggaggacggggacuacuaccggaagcagcucuccccgcuggagggcggcggguggcugguggccagcggcuccacggucgccaugaccgagcagcuccagaugggguucggcaucaccgugcaguacgggaccgacaccaacagcgugugccccaagcuggaguucgcgaacgacacgaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacccacgccacgcuguucggguccguggccugcgagcacaucagcuccaccaugagccaguacucccgcagcacccgcuccaugcucaagcggcgcgacagcaccuacggcccgcugcagacgcccgucgggugcgugcugggccucgugaacuccagccuguucgucgaggacugcaagcugccccucgggcagagccugugcgcccugcccgacaccccguccacccucacgcccuga

SEQ ID NO: 1728 - RNA, 2244 nt, Artificial Sequence
  derived and/or modified CDS sequence (opt1) from MERS-CoV__AJG44069__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccgcaagcuguucgucgccaacuacucccaggacgugaagcaguucgccaacggguucgugguccggaucggcgccgcggccaacagcaccgggaccgugaucaucucccccagcaccuccgccaccauccgcaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccgccaccgacugcagcgacggcaacuacaaccgcaacgccucccucaacagcuucaaggaguacuucaaccugcggaacugcaccuucauguacaccuacaacaucacggaggacgagauccuggagugguucgggaucacccagaccgcgcagggcgugcaccucuucagcucccgcuacguggaccuguacgggggcaacauguuccaguucgccacccugccggucuacgacacgaucaaguacuacagcaucaucccccacuccauccggagcauccaguccgaccgcaaggccugggccgccuucuacguguacaagcuccagccccugaccuuccugcucgacuucagcguggacggguacauccggcgcgcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcggcugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccgccuccuguccgacgaccggaccgaggucccccagcuggugaacgccaaccaguacagccccugcguguccaucguccccagcacggugugggaggacggggacuacuaccgcaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcggggcguguuccagaacugcaccgccgucggggugcgccagcagcgguucguguacgacgcguaccagaaccuggucggcuacuacuccgacgacggcaacuacuacugccugcgcgccugcgugagcgugcccgucuccgugaucuacgacaaggagaccaagacgcacgccacccuguucgggagcguggccugcgagcacaucuccagcaccaugucccaguacagccgcuccacccggagcaugcucaagcgccgggacuccacguacggcccgcugcagacccccgucgggugcgugcugggccucgugaacagcucccuguucgucgaggacugcaagcugccccucgggcagagccugugcgcccugcccgacaccccgagcccccucacgcccuga

SEQ ID NO: 1729 - RNA, 2244 nt, Artificial Sequence
  derived and/or modified CDS sequence (opt1) from MERS-CoV__AJG44080__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcaucaaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccgcugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcccccucacgcccuga

SEQ ID NO: 1730 - RNA, 2244 nt, Artificial Sequence
  derived and/or modified CDS sequence (opt1) from MERS-CoV__AJG44102__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugucccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucagcccccuggagggcggcggguggcugguggccuccggcuccaccgucgcgaugaccgagcagcuccagaugggguucggcaucaccgugcaguacgggaccgacacgaacagcgugugcccgaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaucagccaguacucccgcagcacccgcuccaugcucaagcggcgcgacagcacguacggcccccugcagaccccggucgggugcgugcugggccucgugaacuccagccuguucgucgaggacugcaagcugccccucgggcagagccugugcgcccugcccgacacccccuccacccucacgccguga

SEQ ID NO: 1731 - RNA, 2244 nt, Artificial Sequence
  derived and/or modified CDS sequence (opt1) from MERS-CoV__AJG44124__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccauguuccaguacucccgcagcacccgcuccaugcucaagcggcgcgacagcacguacggcccgcugcagacccccgucgggugcgugcugggccucgugaacuccagccuguucgucgaggacugcaagcugccccucgggcagucccugugcgcccugcccgacaccccgagcacccucacgcccuga

SEQ ID NO: 1732 - RNA, 2244 nt, Artificial Sequence
  derived and/or modified CDS sequence (opt1) from MERS-CoV__ALL26396__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccugagcgucgaggacugcaagcugccccucgggcagagccugugcgcccugcccgacaccccguccacccucacgcccuga

SEQ ID NO: 1733 - RNA, 2244 nt, Artificial Sequence
  derived and/or modified CDS sequence (opt1) from MERS-CoV__ALS20350__S1
augauccacagcguguuccugcucauguuccugcugacccccaccgaguccuacgucgacgugggcccggacagcgccaaguccgccugcaucgagguggacauccagcagacguucuucgacaagaccuggccccgccccaucgacgucagcaaggcggacgggaucaucuacccccagggccggaccuacuccaacaucaccaucacguaccagggccucuucccguaccagggcgaccacggggacauguacguguacagcgccggccacgccaccggcaccacgccccagaagcuguucguggccaacuacucccaggacgucaagcaguucgccaacggguucguggugcgcaucggcgcggccgccaacagcaccgggaccgucaucaucucccccagcaccuccgccaccauccggaagaucuaccccgcguucaugcugggcagcuccguggggaacuucagcgacggcaagaugggccgcuucuucaaccacacgcucgugcugcugccggacgggugcggcacccuccugcgggccuucuacugcauccuggagccccgcuccgggaacuacugccccgccggcaacagcuacaccuccuucgccaccuaccacacgcccgccaccgacugcagcgacggcaacuacaaccggaacgcgucccucaacagcuucaaggaguacuucaaccugcgcaacugcaccuucauguacaccuacaacaucacggaggacgagauccuggagugguucgggaucacccagaccgcccagggcguccaccucuucagcucccgguacguggaccuguacgggggcaacauguuccaguucgccacccugccgguguacgacacgaucaaguacuacagcaucaucccccacuccauccgcagcauccaguccgaccggaaggccugggccgcguucuacgucuacaagcuccagccccugaccuuccugcucgacuucagcguggacggguacauccgccgggccaucgacugcggcuucaacgaccugucccagcugcacugcagcuacgaguccuucgacguggagagcggcgucuacuccgugagcuccuucgaggccaagcccagcggguccguggucgagcaggccgagggcguggagugcgacuucagcccgcuccuguccgggaccccgccccagguguacaacuucaagcgccuggucuucaccaacugcaacuacaaccucacgaagcugcugagccucuucuccgugaacgacuucacgugcagccagaucagccccgccgcgaucgccuccaacugcuacagcucccugauccuggacuacuucagcuacccccucuccaugaaguccgaccugagcgucagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggugccccagcuggucaacgccaaccaguacagccccugcguguccaucgugcccagcacggucugggaggacggggacuacuaccggaagcagcucagcccgcuggagggcggcggguggcugguggcguccggcagcaccguggccaugaccgagcagcuccagaugggguucggcaucaccguccaguacgggaccgacacgaacuccgugugccccaagcuggaguucgccaacgacaccaagaucgccagccagcugggcaacugcguggaguacucccucuacggcgucagcgggcgcggcguguuccagaacugcaccgcgguggggguccggcagcagcgcuucguguacgacgccuaccagaaccuggugggcuacuacuccgacgacggcaacuacuacugccugcgggccugcgucaccgugcccgugagcgucaucuacgacaaggagacgaagacccacgccacccuguucggguccguggccugcgagcacaucagcuccaccaugagccaguacucccgcagcacgcgcuccaugcucaagcggcgcgacagcaccuacggcccgcugcagacccccguggggugcguccugggccucgugaacuccagccuguucguggaggacugcaagcugccccucgggcagucccugugcgcgcugcccgacaccccgagcacgcucacgcccuga

SEQ ID NO: 1734 - RNA, 2244 nt, Artificial Sequence; identical to SEQ ID NO: 1650
  derived and/or modified CDS sequence (opt1) from MERS-CoV__ALT66880__S1

SEQ ID NO: 1735 - RNA, 2244 nt, Artificial Sequence
  derived and/or modified CDS sequence (opt1) from MERS-CoV__ALA49341__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacccugcagaagcuguucgucgccaacuacucccaggacgugaagcaguucgccaacggguucgugguccgcaucggcgccgcggccaacagcacggggaccgugaucaucucccccagcaccuccgccaccauccggaagaucuaccccgccuucaugcucggcagcuccguggggaacuucagcgacggcaagaugggccgcuucuucaaccacacgcugguccugcuccccgacgggugcggcacccugcugcgggcguucuacugcauccucgagccgcgcuccgggaaccacugccccgccggcaacagcuacaccuccuucgccaccuaccacacgcccgccaccgacugcagcgacggcaacuacaaccggaacgccucccugaacagcuucaaggaguacuucaaccugcgcaacugcaccuucauguacaccuacaacaucacggaggacgagauccucgagugguucgggaucacccagaccgcgcagggcgugcaccuguucagcucccgguacguggaccuguacgggggcaacauguuccaguucgccacccuccccgucuacgacacgaucaaguacuacagcaucaucccgcacuccauccgcagcauccaguccgaccggaaggccugggccgccuucuacguguacaagcugcagccccugaccuuccuccuggacuucagcguggacggguacauccgccgggcgaucgacugcggcuucaacgaccugucccagcuccacugcagcuacgaguccuucgacgucgagagcggcguguacuccgugagcuccuucgaggccaagcccagcggguccgucguggagcaggccgagggcguggagugcgacuucagcccccugcuguccgggaccccgccccaggucuacaacuucaagcgccucguguucaccaacugcaacuacaaccugacgaagcugcucagccuguucuccgucaacgacuucaucugcagccagaucagccccgccgccaucgcguccaacugcuacagcucccugauccucgacuacuucagcuacccccuguccaugaaguccgaccugagcgugagcuccgccggcccgaucagccaguucaacuacaagcaguccuucagcaaccccacgugccucauccuggccaccgugccccacaaccugaccacgaucaccaagccccucaaguacuccuacaucaacaagugcagccggcugcuguccgacgaccgcaccgaggucccgcagcucgugaacgccaaccaguacagccccugcguguccaucguccccagcaccgugugggaggacggggacuacuaccggaagcagcugagcccccuggagggcggcggguggcucguggccuccggcagcacggucgcgaugaccgagcagcugcagaugggguucggcaucaccgugcaguacgggaccgacaccaacuccgugugcccgaagcuggaguucgccaacgacacgaagaucgccagccagcucggcaacugcgucgaguacucccuguacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacccacgccacccucuucgggagcguggccugcgagcacaucuccagcaccaugucccaguacagccgcuccacccgcagcaugcugaagcggcgcgacuccaccuacggcccccugcagacgccggucgggugcgugcucggccuggugaacagcucccuguucgucgaggacugcaagcucccccuggggcagagccugugcgcccuccccgacacccccagcacccugaccccguga

SEQ ID NO: 1736 - RNA, 2244 nt, Artificial Sequence
  derived and/or modified CDS sequence (opt1) from MERS-CoV__ALA49352__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuacuacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1737 - RNA, 2244 nt, Artificial Sequence
  derived and/or modified CDS sequence (opt1) from MERS-CoV__ALA49363__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccaccuucccggucuacgacacgaucaaguacuacagcaucaucccccacuccauccgcagcauccaguccgaccggaaggccugggccgccuucuacguguacaagcugcagccccucaccuuccugcuggacuucagcguggacggguacauccgccgggcgaucgacugcggcuucaacgaccucucccagcugcacugcagcuacgaguccuucgacgucgagagcggcguguacuccgugagcuccuucgaggccaagcccagcggguccgucguggagcaggccgagggcguggagugcgacuucagcccgcugcucuccgggaccccgccccaggucuacaacuucaagcgccugguguucaccaacugcaacuacaaccugacgaagcuccugagccuguucuccgucaacgacuucacgugcagccagaucagccccgccgccaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccaccaucaccaagccccugaaguacuccuacaucaacaagugcagccggcugcucuccgacgaccgcaccgaggucccccagcuggugaacgccaaccaguacagccccugcguguccaucguccccagcacggugugggaggacggggacuacuaccggaagcagcugagcccgcucgagggcggcggguggcugguggccuccggcagcaccgucgcgaugaccgagcagcugcagaugggguucggcaucaccgugcaguacgggaccgacacgaacuccgugugccccaagcucgaguucgccaacgacaccaagaucgccagccagcugggcaacugcgucgaguacucccuguacggcgugagcgggcgcggcguguuccagaacugcaccgccgucggggugcggcagcagcgcuucguguacgacgcguaccagaaccucgucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcugaagcggcgcgacuccacguacggcccgcuccagacccccgucgggugcgugcugggccuggugaacagcucccucuucgucgaggacugcaagcugccccuggggcagagccucugcgcccugcccgacaccccgagcacccugacgcccuga

SEQ ID NO: 1738 - RNA, 2244 nt, Artificial Sequence; identical to SEQ ID NO: 1670
  derived and/or modified CDS sequence (opt1) from MERS-CoV__ALA49374__S1

SEQ ID NO: 1739 - RNA, 2244 nt, Artificial Sequence
  derived and/or modified CDS sequence (opt1) from MERS-CoV__ALA49396__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccagcuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgcgaugaccgagcagcuccagaugggguucggcaucaccgugcaguacgggaccgacacgaacagcgugugccccaagcuggaguucgccaacgacaccaagaucgccucccagcugggcaacugcgucgaguacagccucuacggcguguccgggcgcggcguguuccagaacugcaccgccgucggggugcggcagcagcgcuucguguacgacgcguaccagaaccuggucggcuacuacagcgacgacggcaacuacuacugccugcgggccugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgcccuga

SEQ ID NO: 1740 - RNA, 2244 nt, Artificial Sequence
  derived and/or modified CDS sequence (opt1) from MERS-CoV__ALA49451__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaaccugccccucgggcagagccugugcgcccugcccgacaccccgagcacccucacgcccuga

SEQ ID NO: 1741 - RNA, 2244 nt, Artificial Sequence
  derived and/or modified CDS sequence (opt1) from MERS-CoV__ALA49473__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccaccaccgacugcagcgacggcaacuacaaccggaacgccucccucaacagcuucaaggaguacuucaaccugcgcaacugcaccuucauguacacguacaacaucaccgaggacgagauccuggagugguucgggaucacccagaccgcccagggcgugcaccucuucagcucccgguacguggaccuguacgggggcaacauguuccaguucgcgacgcugccggucuacgacaccaucaaguacuacagcaucaucccccacuccauccgcagcauccaguccgaccggaaggccugggccgccuucuacguguacaagcuccagccccugaccuuccugcucgacuucagcguggacggguacauccgccgggccaucgacugcggcuucaacgaccugucccagcugcacugcagcuacgaguccuucgacgucgagagcggcguguacuccgugagcuccuucgaggcgaagcccagcggguccgucguggagcaggccgagggcguggagugcgacuucagcccgcuccuguccgggaccccgccccaggucuacaacuucaagcgccugguguucacgaacugcaacuacaaccucaccaagcugcugagccucuucuccgucaacgacuucacgugcagccagaucagccccgccgccaucgccuccaacugcuacagcucccugauccuggacuacuucagcuacccccucuccaugaaguccgaccugagcgugagcuccgcggggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcacggaggucccccagcuggugaacgccaaccaguacagccccugcguguccaucguccccagcaccgugugggaggacggggacuacuaccggaagcagcucagcccgcuggagggcggcggguggcugguggccuccggcagcaccgucgccaugaccgagcagcuccagaugggguucggcaucaccgugcaguacgggacggacaccaacuccgugugccccaagcuggaguucgcgaacgacaccaagaucgccagccagcugggcaacugcgucgaguacucccucuacggcgugagcgggcgcggcguguuccagaacugcaccgccgucggggugcggcagcagcgcuucguguacgacgccuaccagaaccuggucggcuacuacuccgacgacggcaacuacuacugccugcgggcgugcgugagcgugcccgucuccgugaucuacgacaaggagacgaagacccacgccacccuguucgggagcguggccugcgagcacaucuccagcaccaugucccaguacagccgcuccacgcgcagcaugcucaagcggcgcgacuccaccuacggcccgcugcagacccccgucgggugcgugcugggccucgugaacagcucccuguucgucgaggacugcaagcugccccucgggcagagccugugcgcccugcccgacaccccgagcacgcucacgcccuga

SEQ ID NO: 1742 - RNA, 2244 nt, Artificial Sequence; identical to SEQ ID NO: 1650
  derived and/or modified CDS sequence (opt1) from MERS-CoV__ALA49583__S1

SEQ ID NO: 1743 - RNA, 2244 nt, Artificial Sequence
  derived and/or modified CDS sequence (opt1) from MERS-CoV__ALA49649__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacccccaagaagcuguucgucgccaacuacucccaggacgugaagcaguucgccaacggguucgugguccgcaucggcgccgcggccaacagcacggggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccauccccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccacaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1744 - RNA, 2244 nt, Artificial Sequence
  derived and/or modified CDS sequence (opt1) from MERS-CoV__ALA49660__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaaguucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1745 - RNA, 2244 nt, Artificial Sequence
  derived and/or modified CDS sequence (opt1) from MERS-CoV__ALA49671__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccaacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 1746 - RNA, 2244 nt, Artificial Sequence; identical to SEQ ID NO: 1650
  derived and/or modified CDS sequence (opt1) from MERS-CoV__ALA49682__S1

SEQ ID NO: 1747 - RNA, 2244 nt, Artificial Sequence
  derived and/or modified CDS sequence (opt1) from MERS-CoV__ALA49803__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggaccgcuacguguacagcgcgggccacgccaccggcaccacgccccagaagcuguucgucgccaacuacucccaggacgugaagcaguucgccaacggguucgugguccggaucggcgccgcggccaacagcaccgggaccgugaucaucucccccagcaccuccgccaccauccgcaagaucuaccccgccuucaugcugggcagcuccguggggaacuucagcgacggcaagaugggccgguucuucaaccacacgcucguccugcugccggacgggugcggcacccuccugcgcgcguucuacugcauccuggagccccgguccgggaaccacugccccgccggcaacagcuacaccuccuucgccaccuaccacacgcccagcaccgacugcuccgacggcaacuacaaccgcaacgccagccucaacagcuucaaggaguacuucaaccugcggaacugcaccuucauguacaccuacaacaucacggaggacgagauccuggagugguucgggaucacccagaccgcccagggcgugcaccucuucuccagccgcuacguggaccuguacgggggcaacauguuccaguucgcgacccugccggucuacgacacgaucaaguacuacuccaucaucccccacagcauccgguccauccagagcgaccgcaaggccugggccgccuucuacguguacaagcuccagccccugaccuuccugcucgacuucuccguggacggguacauccggcgcgccaucgacugcggcuucaacgaccugagccagcugcacugcuccuacgagagcuucgacgucgaguccggcguguacagcguguccagcuucgaggcgaagcccuccgggagcgucguggagcaggccgagggcguggagugcgacuucuccccgcuccugagcgggaccccgccccaggucuacaacuucaagcggcugguguucaccaacugcaacuacaaccucacgaagcugcugucccucuucagcgucaacgacuucacgugcagccagaucucccccgccgccaucgccagcaacugcuacuccagccugauccuggacuacuucuccuacccccucagcaugaaguccgaccugagcguguccagcgcggggcccaucucccaguucaacuacaagcagagcuucuccaacccgaccugccugauccucgccaccgugccccacaaccugaccaccaucaccaagccccugaaguacagcuacaucaacaagugcucccgccuccugagcgacgaccggaccgaggucccccagcuggugaacgccaaccaguacucccccugcgugagcaucguccccagcacggugugggaggacggggacuacuaccgcaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcggggcguguuccagaacugcaccgccgucggggugcgccagcagcgguucguguacgacgccuaccagaaccuggucggcuacuacagcgacgacggcaacuacuacugccugcgcgcgugcguguccgugcccgucagcgugaucuacgacaaggagaccaagacgcacgccacccuguucggguccguggccugcgagcacaucagcuccaccaugagccaguacucccgcagcacccgguccaugcucaagcgccgggacagcacguacggcccgcugcagacccccgucgggugcgugcugggccucgugaacuccagccuguucgucgaggacugcaagcugccccucgggcagagccugugcgcccugcccgacaccccguccacccucacgcccuga

SEQ ID NO: 1748 - RNA, 2244 nt, Artificial Sequence; identical to SEQ ID NO: 1739
  derived and/or modified CDS sequence (opt1) from MERS-CoV__ALA49836__S1

SEQ ID NO: 1749 - RNA, 2244 nt, Artificial Sequence; identical to SEQ ID NO: 1650
  derived and/or modified CDS sequence (opt1) from MERS-CoV__ALA49957__S1

SEQ ID NO: 1750 - RNA, 2244 nt, Artificial Sequence
  derived and/or modified CDS sequence (opt1) from MERS-CoV__ALA50067__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccagcgggcccaucucccaguucaacuacaagcagagcuucuccaacccgaccugccugauccucgccaccgugccccacaaccugaccaccaucaccaagccccugaaguacagcuacaucaacaagugcucccggcuccugagcgacgaccgcaccgaggucccccagcuggugaacgccaaccaguacucccccugcgugagcaucguccccagcacggugugggaggacggggacuacuaccggaagcagcucuccccgcuggagggcggcggguggcugguggccagcggcuccaccgucgccaugaccgagcagcuccagaugggguucggcaucaccgugcaguacgggaccgacacgaacagcgugugccccaagcuggaguucgcgaacgacaccaagaucgccucccagcugggcaacugcgucgaguacagccucuacggcguguccgggcgcggcguguuccagaacugcaccgccgucggggugcggcagcagcgcuucguguacgacgccuaccagaaccuggucggcuacuacagcgacgacggcaacuacuacugccugcgggcgugcguguccgugcccgucagcgugaucuacgacaaggagaccaagacgcacgccacccuguucggguccguggccugcgagcacaucagcuccaccaugagccaguacucccgcagcacccgcuccaugcucaagcggcgcgacagcacguacggcccgcugcagacccccgucgggugcgugcugggccucgugaacuccagccuguucgucgaggacugcaagcugccccucgggcagagccugugcgcccugcccgacaccccguccacccucacgcccuga

SEQ ID NO: 1751 - RNA, 2244 nt, Artificial Sequence
  derived and/or modified CDS sequence (opt2) from MERS-CoV__AFS88936__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1752 - RNA, 2244 nt, Artificial Sequence
  derived and/or modified CDS sequence (opt2) from MERS-CoV__AFY13307__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgcuuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1753 - RNA, 2244 nt, Artificial Sequence
  derived and/or modified CDS sequence (opt2) from MERS-CoV__AGH58717__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccgucaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccucuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1754 - RNA, 2244 nt, Artificial Sequence
  derived and/or modified CDS sequence (opt2) from MERS-CoV__AGN52936__S1
augauccacuccgucuuccuccucauguuccuccucacccccaccgaguccuacgucgacgucggccccgacuccaucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1755 - RNA, 2244 nt, Artificial Sequence; identical to SEQ ID NO: 1751
  derived and/or modified CDS sequence (opt2) from MERS-CoV__AGN70951__S1

SEQ ID NO: 1756 - RNA, 2244 nt, Artificial Sequence
  derived and/or modified CDS sequence (opt2) from MERS-CoV__AGV08408__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccggcgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1757 - RNA, 2244 nt, Artificial Sequence
  derived and/or modified CDS sequence (opt2) from MERS-CoV__AGV08455__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccuacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1758 - RNA, 2244 nt, Artificial Sequence; identical to SEQ ID NO: 1751
  derived and/or modified CDS sequence (opt2) from MERS-CoV__AGV08467__S1

SEQ ID NO: 1759 - RNA, 2244 nt, Artificial Sequence; identical to SEQ ID NO: 1751
  derived and/or modified CDS sequence (opt2) from MERS-CoV__AGV08492__S1

SEQ ID NO: 1760 - RNA, 2244 nt, Artificial Sequence
  derived and/or modified CDS sequence (opt2) from MERS-CoV__AGV08584__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgccugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1761 - RNA, 2244 nt, Artificial Sequence
  derived and/or modified CDS sequence (opt2) from MERS-CoV__AHB33326__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccuacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1762 - RNA, 2244 nt, Artificial Sequence
  derived and/or modified CDS sequence (opt2) from MERS-CoV__AHC74088__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuucgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1763 - RNA, 2244 nt, Artificial Sequence
  derived and/or modified CDS sequence (opt2) from MERS-CoV__AHI48528__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucuccccccccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgucaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1764 - RNA, 2244 nt, Artificial Sequence; identical to SEQ ID NO: 1751
  derived and/or modified CDS sequence (opt2) from MERS-CoV__AHI48550__S1

SEQ ID NO: 1765 - RNA, 2244 nt, Artificial Sequence
  derived and/or modified CDS sequence (opt2) from MERS-CoV__AHI48583__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuucaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1766 - RNA, 2244 nt, Artificial Sequence; identical to SEQ ID NO: 1751
  derived and/or modified CDS sequence (opt2) from MERS-CoV__AHI48605__S1

SEQ ID NO: 1767 - RNA, 2244 nt, Artificial Sequence; identical to SEQ ID NO: 1753
  derived and/or modified CDS sequence (opt2) from MERS-CoV__AHY21469__S1

SEQ ID NO: 1768 - RNA, 2244 nt, Artificial Sequence
  derived and/or modified CDS sequence (opt2) from MERS-CoV__AHZ64057__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuucuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1769 - RNA, 2244 nt, Artificial Sequence; identical to SEQ ID NO: 1751
  derived and/or modified CDS sequence (opt2) from MERS-CoV__AID50418__S1

SEQ ID NO: 1770 - RNA, 2244 nt, Artificial Sequence; identical to SEQ ID NO: 1751
  derived and/or modified CDS sequence (opt2) from MERS-CoV__AID55068__S1

SEQ ID NO: 1771 - RNA, 2244 nt, Artificial Sequence
  derived and/or modified CDS sequence (opt2) from MERS-CoV__AID55073__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1772 - RNA, 2244 nt, Artificial Sequence
  derived and/or modified CDS sequence (opt2) from MERS-CoV__AIY60528__S1
augauccacuccgucuuccuccucauguuccuccucacccccaccgaguccuacgucgacgucggccccgacuccuucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccagaacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1773 - RNA, 2244 nt, Artificial Sequence
  derived and/or modified CDS sequence (opt2) from MERS-CoV__AIY60558__S1
augauccacuccgucuuccuccucauguuccuccucacccccaccgaguccuacgucgacgucggccccgacuccuucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1774 - RNA, 2244 nt, Artificial Sequence; identical to SEQ ID NO: 1751
  derived and/or modified CDS sequence (opt2) from MERS-CoV__AIZ74450__S1

SEQ ID NO: 1775 - RNA, 2244 nt, Artificial Sequence
  derived and/or modified CDS sequence (opt2) from MERS-CoV__AJD81440__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucaaccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1776 - RNA, 2244 nt, Artificial Sequence; identical to SEQ ID NO: 1751
  derived and/or modified CDS sequence (opt2) from MERS-CoV__AKI29284__S1

SEQ ID NO: 1777 - RNA, 2244 nt, Artificial Sequence
  derived and/or modified CDS sequence (opt2) from MERS-CoV__AKL59401__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccacccgcgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccauccuccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1778 - RNA, 2244 nt, Artificial Sequence
  derived and/or modified CDS sequence (opt2) from MERS-CoV__AKM76229__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucacccccuga

SEQ ID NO: 1779 - RNA, 2244 nt, Artificial Sequence
  derived and/or modified CDS sequence (opt2) from MERS-CoV__AKM76239__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgagcucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1780 - RNA, 2244 nt, Artificial Sequence
  derived and/or modified CDS sequence (opt2) from MERS-CoV__AKN11072__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaccguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1781 - RNA, 2244 nt, Artificial Sequence
  derived and/or modified CDS sequence (opt2) from MERS-CoV__AKN11074__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaccguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcacuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1782 - RNA, 2244 nt, Artificial Sequence
  derived and/or modified CDS sequence (opt2) from MERS-CoV__AKN24803__S1
augguccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucucccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1783 - RNA, 2244 nt, Artificial Sequence
  derived and/or modified CDS sequence (opt2) from MERS-CoV__AKN24812__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucugcgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1784 - RNA, 2244 nt, Artificial Sequence
  derived and/or modified CDS sequence (opt2) from MERS-CoV__AKN24830__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggccccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1785 - RNA, 2244 nt, Artificial Sequence; identical to SEQ ID NO: 1751
  derived and/or modified CDS sequence (opt2) from MERS-CoV__ALB08257__S1

SEQ ID NO: 1786 - RNA, 2244 nt, Artificial Sequence
  derived and/or modified CDS sequence (opt2) from MERS-CoV__ALB08311__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggcuacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1787 - RNA, 2244 nt, Artificial Sequence; identical to SEQ ID NO: 1786
  derived and/or modified CDS sequence (opt2) from MERS-CoV__ALB08322__S1

SEQ ID NO: 1788 - RNA, 2244 nt, Artificial Sequence; identical to SEQ ID NO: 1751
  derived and/or modified CDS sequence (opt2) from MERS-CoV__ALD51904__S1

SEQ ID NO: 1789 - RNA, 2244 nt, Artificial Sequence
  derived and/or modified CDS sequence (opt2) from MERS-CoV__ALJ54446__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuucuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1790 - RNA, 2244 nt, Artificial Sequence
  derived and/or modified CDS sequence (opt2) from MERS-CoV__ALJ54448__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccauccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1791 - RNA, 2244 nt, Artificial Sequence
  derived and/or modified CDS sequence (opt2) from MERS-CoV__ALJ54450__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcuacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1792 - RNA, 2244 nt, Artificial Sequence
  derived and/or modified CDS sequence (opt2) from MERS-CoV__ALJ54453__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1793 - RNA, 2244 nt, Artificial Sequence
  derived and/or modified CDS sequence (opt2) from MERS-CoV__ALJ54455__S1
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaagcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagcccuga

SEQ ID NO: 1794 - RNA, 2244 nt, Artificial Sequence
  derived and/or modified CDS sequence (opt2) from MERS-CoV__ALJ54456__S1
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagcccuga

SEQ ID NO: 1795 - RNA, 2244 nt, Artificial Sequence
  derived and/or modified CDS sequence (opt2) from MERS-CoV__ALJ54461__S1
augauccacuccgucuuccuccucauguuccuccucacccccaccgaguccuacgucgacgucggccccgacuccgucaagcccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucaccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagaccuccgucggcugcguccucggccucgucaacuccucccucuucgucgaggacugcaagcucccccucggccagucccucugcgcccuccccgacacccccuccacccucacccccuga

SEQ ID NO: 1796 - RNA, 2244 nt, Artificial Sequence
  derived and/or modified CDS sequence (opt2) from MERS-CoV__ALJ54468__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1797 - RNA, 2244 nt, Artificial Sequence
  derived and/or modified CDS sequence (opt2) from MERS-CoV__ALJ54471__S1
augauccacuccgucuaccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1798 - RNA, 2244 nt, Artificial Sequence
  derived and/or modified CDS sequence (opt2) from MERS-CoV__ALJ54472__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccuccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucgcccccuga

SEQ ID NO: 1799 - RNA, 2244 nt, Artificial Sequence
  derived and/or modified CDS sequence (opt2) from MERS-CoV__ALJ54474__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccuccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1800 - RNA, 2244 nt, Artificial Sequence
  derived and/or modified CDS sequence (opt2) from MERS-CoV__ALJ54483__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucuuccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1801 - RNA, 2244 nt, Artificial Sequence
  derived and/or modified CDS sequence (opt2) from MERS-CoV__ALJ54486__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcuacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgucuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1802 - RNA, 2244 nt, Artificial Sequence
  derived and/or modified CDS sequence (opt2) from MERS-CoV__ALJ54488__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacaucuacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1803 - RNA, 2244 nt, Artificial Sequence
  derived and/or modified CDS sequence (opt2) from MERS-CoV__ALJ54490__S1
augauccacuccgucuuccuccucauguuccuccucacccccaccgaguccuacgucgacgucggccccgacuccgucaaguccgccugcaucgccgucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucaagcccuga

SEQ ID NO: 1804 - RNA, 2244 nt, Artificial Sequence
  derived and/or modified CDS sequence (opt2) from MERS-CoV__ALJ54495__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgucuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1805 - RNA, 2244 nt, Artificial Sequence
  derived and/or modified CDS sequence (opt2) from MERS-CoV__ALJ54496__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccccuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1806 - RNA, 2244 nt, Artificial Sequence
  derived and/or modified CDS sequence (opt2) from MERS-CoV__ALJ54500__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucucccuccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1807 - RNA, 2244 nt, Artificial Sequence
  derived and/or modified CDS sequence (opt2) from MERS-CoV__ALJ54501__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccacccucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1808 - RNA, 2244 nt, Artificial Sequence; identical to SEQ ID NO: 1751
  derived and/or modified CDS sequence (opt2) from MERS-CoV__ALJ54502__S1

SEQ ID NO: 1809 - RNA, 2244 nt, Artificial Sequence
  derived and/or modified CDS sequence (opt2) from MERS-CoV__ALJ54512__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcgcccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1810 - RNA, 2244 nt, Artificial Sequence
  derived and/or modified CDS sequence (opt2) from MERS-CoV__ALJ54517__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcaacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1811 - RNA, 2244 nt, Artificial Sequence; identical to SEQ ID NO: 1805
  derived and/or modified CDS sequence (opt2) from MERS-CoV__ALJ54518__S1

SEQ ID NO: 1812 - RNA, 2244 nt, Artificial Sequence
  derived and/or modified CDS sequence (opt2) from MERS-CoV__ALW82691__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccgcuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1813 - RNA, 2244 nt, Artificial Sequence
  derived and/or modified CDS sequence (opt2) from MERS-CoV__ALW82742__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccagaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1814 - RNA, 2244 nt, Artificial Sequence; identical to SEQ ID NO: 1799
  derived and/or modified CDS sequence (opt2) from MERS-CoV__ALW82753__S1

SEQ ID NO: 1815 - RNA, 2244 nt, Artificial Sequence
  derived and/or modified CDS sequence (opt2) from MERS-CoV__ALX27228__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucuggaaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucuccugcguccucggccucgucaacuccucccucuucgucgaggacugcaagcucccccucggccagucccucugcgcccuccccgacacccccuccacccucacccccuga

SEQ ID NO: 1816 - RNA, 2244 nt, Artificial Sequence; identical to SEQ ID NO: 1757
  derived and/or modified CDS sequence (opt2) from MERS-CoV__ALX27232__S1

SEQ ID NO: 1817 - RNA, 2244 nt, Artificial Sequence
  derived and/or modified CDS sequence (opt2) from MERS-CoV__AMQ48993__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaucgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1818 - RNA, 2244 nt, Artificial Sequence
  derived and/or modified CDS sequence (opt2) from MERS-CoV__AMW90844__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccuuccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1819 - RNA, 2244 nt, Artificial Sequence; identical to SEQ ID NO: 1771
  derived and/or modified CDS sequence (opt2) from MERS-CoV__AMW90852__S1

SEQ ID NO: 1820 - RNA, 2244 nt, Artificial Sequence
  derived and/or modified CDS sequence (opt2) from MERS-CoV__AMW90853__S1
augauccacuccgucuuccuccucauguuccuccucacccccaccgaguccuacgucgacgucggcuccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggcuacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaacuucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1821 - RNA, 2244 nt, Artificial Sequence
  derived and/or modified CDS sequence (opt2) from MERS-CoV__ANC28656__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1822 - RNA, 2244 nt, Artificial Sequence
  derived and/or modified CDS sequence (opt2) from MERS-CoV__ANC28678__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccaucugcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacggccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1823 - RNA, 2244 nt, Artificial Sequence
  derived and/or modified CDS sequence (opt2) from MERS-CoV__AHL18090__S1
augauccacuccgucuuccuccucauguuccuccucacccccaccgaguccuacgucgacgucggccucgacuccgccaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucuccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaagaagaccaagacccacgccacccucuucggcuccgucgccugcgagcacaucuccuccaccaugucccaguacucccgcuccacccgcuccacccucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1824 - RNA, 2244 nt, Artificial Sequence
  derived and/or modified CDS sequence (opt2) from MERS-CoV__AHX00731__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucggcgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1825 - RNA, 2244 nt, Artificial Sequence
  derived and/or modified CDS sequence (opt2) from MERS-CoV__AHX71946__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacucccacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1826 - RNA, 2244 nt, Artificial Sequence
  derived and/or modified CDS sequence (opt2) from MERS-CoV__AHY22545__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaaccgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1827 - RNA, 2244 nt, Artificial Sequence
  derived and/or modified CDS sequence (opt2) from MERS-CoV__AHY22555__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaacuacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccuccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacuccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1828 - RNA, 2244 nt, Artificial Sequence
  derived and/or modified CDS sequence (opt2) from MERS-CoV__AHY22565__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaucauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccuccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1829 - RNA, 2244 nt, Artificial Sequence
  derived and/or modified CDS sequence (opt2) from MERS-CoV__AJG44069__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccgcaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucacccccuga

SEQ ID NO: 1830 - RNA, 2244 nt, Artificial Sequence
  derived and/or modified CDS sequence (opt2) from MERS-CoV__AJG44080__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccaucaaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccccccucacccccuga

SEQ ID NO: 1831 - RNA, 2244 nt, Artificial Sequence
  derived and/or modified CDS sequence (opt2) from MERS-CoV__AJG44102__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucucccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaucucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1832 - RNA, 2244 nt, Artificial Sequence
  derived and/or modified CDS sequence (opt2) from MERS-CoV__AJG44124__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccauguuccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1833 - RNA, 2244 nt, Artificial Sequence
  derived and/or modified CDS sequence (opt2) from MERS-CoV__ALL26396__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuccgucgaggacugcaagcucccccucggccagucccucugcgcccuccccgacacccccuccacccucacccccuga

SEQ ID NO: 1834 - RNA, 2244 nt, Artificial Sequence
  derived and/or modified CDS sequence (opt2) from MERS-CoV__ALS20350__S1
augauccacuccgucuuccuccucauguuccuccucacccccaccgaguccuacgucgacgucggccccgacuccgccaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaacuacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucaccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1835 - RNA, 2244 nt, Artificial Sequence; identical to SEQ ID NO: 1751
  derived and/or modified CDS sequence (opt2) from MERS-CoV__ALT66880__S1

SEQ ID NO: 1836 - RNA, 2244 nt, Artificial Sequence
  derived and/or modified CDS sequence (opt2) from MERS-CoV__ALA49341__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccacccuccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaucugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1837 - RNA, 2244 nt, Artificial Sequence
  derived and/or modified CDS sequence (opt2) from MERS-CoV__ALA49352__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuacuacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1838 - RNA, 2244 nt, Artificial Sequence
  derived and/or modified CDS sequence (opt2) from MERS-CoV__ALA49363__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccaccuuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1839 - RNA, 2244 nt, Artificial Sequence; identical to SEQ ID NO: 1771
  derived and/or modified CDS sequence (opt2) from MERS-CoV__ALA49374__S1

SEQ ID NO: 1840 - RNA, 2244 nt, Artificial Sequence
  derived and/or modified CDS sequence (opt2) from MERS-CoV__ALA49396__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuccuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1841 - RNA, 2244 nt, Artificial Sequence
  derived and/or modified CDS sequence (opt2) from MERS-CoV__ALA49451__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaaccucccccucggccagucccucugcgcccuccccgacacccccuccacccucacccccuga

SEQ ID NO: 1842 - RNA, 2244 nt, Artificial Sequence
  derived and/or modified CDS sequence (opt2) from MERS-CoV__ALA49473__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccaccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1843 - RNA, 2244 nt, Artificial Sequence; identical to SEQ ID NO: 1751
  derived and/or modified CDS sequence (opt2) from MERS-CoV__ALA49583__S1

SEQ ID NO: 1844 - RNA, 2244 nt, Artificial Sequence
  derived and/or modified CDS sequence (opt2) from MERS-CoV__ALA49649__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccacccccaagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccauccccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccacaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1845 - RNA, 2244 nt, Artificial Sequence
  derived and/or modified CDS sequence (opt2) from MERS-CoV__ALA49660__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaaguucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1846 - RNA, 2244 nt, Artificial Sequence
  derived and/or modified CDS sequence (opt2) from MERS-CoV__ALA49671__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccaacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1847 - RNA, 2244 nt, Artificial Sequence; identical to SEQ ID NO: 1751
  derived and/or modified CDS sequence (opt2) from MERS-CoV__ALA49682__S1

SEQ ID NO: 1848 - RNA, 2244 nt, Artificial Sequence
  derived and/or modified CDS sequence (opt2) from MERS-CoV__ALA49803__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgaccgcuacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccuccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccgccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1849 - RNA, 2244 nt, Artificial Sequence; identical to SEQ ID NO: 1840
  derived and/or modified CDS sequence (opt2) from MERS-CoV__ALA49836__S1

SEQ ID NO: 1850 - RNA, 2244 nt, Artificial Sequence; identical to SEQ ID NO: 1751
  derived and/or modified CDS sequence (opt2) from MERS-CoV__ALA49957__S1

SEQ ID NO: 1851 - RNA, 2244 nt, Artificial Sequence
  derived and/or modified CDS sequence (opt2) from MERS-CoV__ALA50067__S1
augauccacuccgucuuccuccucauguuccuccucacccccaccgaguccuacgucgacgucggccccgacuccgucaaguccgccugcaucgaggucgacauccagcagaccuucuucgacaagaccuggccccgccccaucgacgucuccaaggccgacggcaucaucuacccccagggccgcaccuacuccaacaucaccaucaccuaccagggccucuuccccuaccagggcgaccacggcgacauguacgucuacuccgccggccacgccaccggcaccaccccccagaagcucuucgucgccaacuacucccaggacgucaagcaguucgccaacggcuucgucguccgcaucggcgccgccgccaacuccaccggcaccgucaucaucucccccuccaccuccgccaccauccgcaagaucuaccccgccuucaugcucggcuccuccgucggcaacuucuccgacggcaagaugggccgcuucuucaaccacacccucguccuccuccccgacggcugcggcacccuccuccgcgccuucuacugcauccucgagccccgcuccggcaaccacugccccgccggcaacuccuacaccuccuucgccaccuaccacacccccgccaccgacugcuccgacggcaacuacaaccgcaacgccucccucaacuccuucaaggaguacuucaaccuccgcaacugcaccuucauguacaccuacaacaucaccgaggacgagauccucgagugguucggcaucacccagaccgcccagggcguccaccucuucuccucccgcuacgucgaccucuacggcggcaacauguuccaguucgccacccuccccgucuacgacaccaucaaguacuacuccaucaucccccacuccauccgcuccauccaguccgaccgcaaggccugggccgccuucuacgucuacaagcuccagccccucaccuuccuccucgacuucuccgucgacggcuacauccgccgcgccaucgacugcggcuucaacgaccucucccagcuccacugcuccuacgaguccuucgacgucgaguccggcgucuacuccgucuccuccuucgaggccaagcccuccggcuccgucgucgagcaggccgagggcgucgagugcgacuucuccccccuccucuccggcacccccccccaggucuacaacuucaagcgccucgucuucaccaacugcaacuacaaccucaccaagcuccucucccucuucuccgucaacgacuucaccugcucccagaucucccccgccgccaucgccuccaacugcuacuccucccucauccucgacuacuucuccuacccccucuccaugaaguccgaccucuccgucuccuccuccggccccaucucccaguucaacuacaagcaguccuucuccaaccccaccugccucauccucgccaccgucccccacaaccucaccaccaucaccaagccccucaaguacuccuacaucaacaagugcucccgccuccucuccgacgaccgcaccgaggucccccagcucgucaacgccaaccaguacucccccugcgucuccaucguccccuccaccgucugggaggacggcgacuacuaccgcaagcagcucuccccccucgagggcggcggcuggcucgucgccuccggcuccaccgucgccaugaccgagcagcuccagaugggcuucggcaucaccguccaguacggcaccgacaccaacuccgucugccccaagcucgaguucgccaacgacaccaagaucgccucccagcucggcaacugcgucgaguacucccucuacggcgucuccggccgcggcgucuuccagaacugcaccgccgucggcguccgccagcagcgcuucgucuacgacgccuaccagaaccucgucggcuacuacuccgacgacggcaacuacuacugccuccgcgccugcgucuccguccccgucuccgucaucuacgacaaggagaccaagacccacgccacccucuucggcuccgucgccugcgagcacaucuccuccaccaugucccaguacucccgcuccacccgcuccaugcucaagcgccgcgacuccaccuacggcccccuccagacccccgucggcugcguccucggccucgucaacuccucccucuucgucgaggacugcaagcucccccucggccagucccucugcgcccuccccgacacccccuccacccucacccccuga

SEQ ID NO: 1852 - RNA, 2244 nt, Artificial Sequence
  derived and/or modified CDS sequence (opt3) from MERS-CoV__AFS88936__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1853 - RNA, 2244 nt, Artificial Sequence
  derived and/or modified CDS sequence (opt3) from MERS-CoV__AFY13307__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagauuucuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccauga

SEQ ID NO: 1854 - RNA, 2244 nt, Artificial Sequence
  derived and/or modified CDS sequence (opt3) from MERS-CoV__AGH58717__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccgugacaaccccacaaaaauuauuuguugcgaauuauucucaggacgugaagcaguucgcuaacggcuuugucgugcggauaggugccgcagccaauucgacugggacaguaaucauuucacccagcaccagugcuacgauccgcaaaauuuacccugcauucaugcugggauccucuguuggcaacuuuagcgauggcaagauggggcgauucuuuaaucauacucuagugcuccugccagacggaugugguacccuucugcgugccuucuacugcaucuuggagcccagauccggcaacuauuguccugcuggcaauucauacacaaguuuugccacuuaucacaccccagcgacagauugcagcgacggaaacuacaauaggaacgcaucucucaauuccuucaaggaauauuucaaccugcggaauuguaccuuuauguacacguauaacauaacugaggaugaaauucuggagugguucggcaucacacagaccgcccaagguguccaucucuuuucaagccgcuacguggacuuauacgggggaaauauguuccaguuugcuacucugccgguguaugacacaauuaaauacuauaguaucaucccccacucuauucuuuccauacagagcgauagaaaggccugggcagcuuucuacgucuauaaauugcagccucugaccuuucuacucgacuucucgguugauggcuacaucaggcgggccauugacugcggcuuuaacgaucugucucaacuucacuguuccuaugagucauucgacguggaaagugggguauacagcguguccucuuuugaggcgaagccaagcggaucagucguggaacaggccgaggguguugagugcgauuucaguccccuguuguccggcacgccuccacagguguacaacuuuaaacgccucgucuucaccaauuguaacuauaaucugacaaaguuacugagccucuucucugugaacgacuuuacuugcucacaaaucagucccgcagcuauagccagcaauuguuacuccucucuuauucuggauuauuucucguacccguugagcaugaaguccgaccuaucaguaaguucugcugggccuaucagccaguuuaacuauaaacaguccuucucaaauccaaccugccugauccucgccacaguuccccauaaccugacuaccauuacaaagccucuuaaauacagcuauaucaauaagugcucucgacuguuguccgaugacagaaccgaagugccccagcucgucaacgcaaaucaauacaguccaugugugagcauuguccccucuacugugugggaggacggagauuacuauaggaaacagcuguccccuuuagaaggcgguggguggcugguugccucaggcaguacgguggcuaugacagagcagcuacagaugggauuuggcauaaccguacaauacgggacugacaccaacagcgucugcccaaagcucgaguucgcgaaugauacaaaaaucgcaucgcagcugggaaacuguguggaauauucccuuuacgguguuucuggccgugggguguuucagaauugcaccgccgucggagugcggcagcaacgcuucguauaugacgcuuaccagaacuuggugggcuauuacagcgaugacgguaacuacuauugucugagagccugcguuucagucccggugagugugauuuacgauaaggagacuaagacacacgcaacgcucuuuggguccgucgccugugaacauaucucuagcaccaugucccaguauucaaggagcacucggaguaugcugaaacgacgcgacucuacauacggcccccuucagaccccuguuggaugcgugcugggcuugguaaauuccagccucuucguggaggauuguaagcugccauuagggcaaucgcugugcgcucuacccgacacaccuucaacucucaccccauga

SEQ ID NO: 1855 - RNA, 2244 nt, Artificial Sequence
  derived and/or modified CDS sequence (opt3) from MERS-CoV__AGN52936__S1
augauccacagcguguuccugcucauguuucuucugacccccacagaguccuacgucgacguuggcccugauucuauuaagucagccugcauagaaguggacauccagcaaacuuucuuugauaaaacguggccaagaccgauugacguaaguaaggcugaugggaucauuuauccccagggaaggaccuacagcaacaucacaauaacuuaucaggguuuguucccuuaccagggcgaccauggggauauguauguguacuccgcaggacacgccaccggcacaaccccacaaaaauuauuugucgcgaauuauucucaggacgugaagcaguucgcuaacgguuuuguugugcggaucggggccgcagccaauucgacuggaacagucauuaucucacccagcaccagugcuacgauucgcaaaaucuacccugcauucaugcugggcuccucugugggcaacuuuagcgaugggaagaugggacgauucuuuaaucauacucuaguacuccugccagacgguuguggcacccuucugcgugccuucuacugcauauuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauuacugaggaugaaauccuggagugguucgguauuacacagaccgcccaagggguucaccucuuuucaagccgcuauguggacuuauacggaggcaauauguuccaguuugcuacucugccggucuacgacacaaucaaauauuacaguaucauuccccacucuauaagauccauccagagcgauaggaaggccugggcagcuuucuauguguacaaacuucagccuuugaccuuucugcuagacuucucgguggauggcuauauucggcgcgccaucgacugcggguuuaacgaucucucucaacugcauuguuccuacgagucauucgacgucgaaaguggaguuuauagcguguccucuuuugaggcgaagccaagcgguucaguaguggaacaggccgagggcgucgagugcgauuucaguccccuucuguccgggacgccuccacagguguacaacuuuaaacgauugguuuucaccaauuguaacuacaaucucacaaagcuguuaagccuguucucugugaacgacuuuacuugcucacaaauaagucccgcagcuauugccagcaauuguuauuccucucucauccuugauuacuucucguauccgcugagcaugaaguccgacuugucagucaguucugcuggaccuaucagccaguuuaacuacaaacaguccuucucaaauccaaccugccuaauucuggccacagugccccacaaccucacuaccaucacaaagccucugaaauauagcuacauuaauaagugcucuagacuucuguccgaugacaggaccgaaguaccccaguugguuaacgcaaaucaauauaguccaugugugagcauaguccccucuacugugugggaggacggcgauuacuaccggaaacagcucuccccucuggaaggugggggcugguuagucgccucaggaaguacgguggcuaugacagagcagcugcagaugggcuuugggaucaccguucaauauggaacugacaccaacagcgugugcccaaagcuagaguucgcgaaugauacaaaaauugcaucgcagcucgguaacuguguagaauacucccuguauggcgucucugggcguggaguguuucagaauugcaccgccguuggcgugcgccagcaaagauucgucuacgacgcuuaucagaaccuuguggguuacuauagcgaugacgggaacuacuacuguuugagggccugcguaucagugccgguuagugucaucuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcucugcccgacacaccuucaacucuaaccccauga

SEQ ID NO: 1856 - RNA, 2244 nt, Artificial Sequence; identical to SEQ ID NO: 1852
  derived and/or modified CDS sequence (opt3) from MERS-CoV__AGN70951__S1

SEQ ID NO: 1857 - RNA, 2244 nt, Artificial Sequence
  derived and/or modified CDS sequence (opt3) from MERS-CoV__AGV08408__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccggcgauaggaccgaaguuccccaguuggugaacgcaaaucaauauaguccaugugucagcauugugcccucuacugucugggaggacggugacuacuaccggaaacagcucuccccucuggaagggggcggaugguuaguggccucaggcaguacgguugcuaugacagagcagcugcagaugggguuuggaauaaccgugcaauaugguacugauaccaacagcguaugcccaaagcuagaguucgcgaaugacacaaaaaucgcaucgcagcucggcaacugugucgaauacucccuguauggggugucuggacguggcguuuuucagaauugcaccgccguggguguccgccagcaaagauucguguacgaugcuuaucagaaccuuguaggguacuauagcgacgauggcaacuacuacuguuugagggccugcgugucaguuccggucagugugauuuaugacaaggagacuaagacacaugcaacgcuguuuggauccguggccugugaacacaucucuagcaccaugucccaguacucacggagcacucgaaguaugcucaaacgcagagauucuacauauggcccccugcagaccccugucgggugcguucuuggacugguaaauuccagcuuguucguggaggacuguaagcucccacugggucaaucguuaugcgcucugcccgauacaccuucaacucuaaccccauga

SEQ ID NO: 1858 - RNA, 2244 nt, Artificial Sequence
  derived and/or modified CDS sequence (opt3) from MERS-CoV__AGV08455__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcuacgggaagaugggacgauucuuuaaucauacucuaguucuccugccagaugguuguggcacccuucugcgugccuucuauugcaucuuggagcccagauccgggaaccacuguccugcuggaaauucauacacaaguuuugccacuuaucauaccccagcgacagacugcagcgauggcaacuacaauaggaacgcaucucucaauuccuucaaggaauauuucaaccugcggaauuguaccuuuauguacacguauaacauaacugaggacgaaauucuggagugguucgguaucacacagaccgcccaaggggugcaccucuuuucaagccgcuacgucgauuuauacggaggcaauauguuccaguuugcuacucugccgguguaugacacaauuaaauacuauaguaucaucccccacucuauuagauccauacagagcgacaggaaggccugggcagcuuucuacguguauaaacuucagccuuugaccuuucugcuagauuucucggucgacggcuacauccggcgcgccauugauugcggguuuaacgaccucucucaacugcauuguuccuaugagucauucgauguugaaaguggaguguacagcguauccucuuuugaggcgaagccaagcgguucaguggucgaacaggccgagggcguggagugcgacuucaguccccuucuguccgggacgccuccacagguuuacaacuuuaaacgauugguguucaccaauuguaacuauaaucucacaaagcuguuaagccuguucucugucaacgauuuuacuugcucacaaaucagucccgcagcuauagccagcaauuguuacuccucucucauucuugacuauuucucguacccgcugagcaugaaguccgauuugucagugaguucugcuggaccuaucagccaguuuaacuauaaacaguccuucucaaauccaaccugccuaauccuggccacaguaccccacaaccucacuaccauuacaaagccucugaaauacagcuauaucaauaagugcucuagacuucuguccgacgauaggaccgaaguuccccaguuggugaacgcaaaucaauacaguccaugugucagcauugugcccucuacugucugggaggacggcgacuacuaucggaaacagcucuccccucuggaaggugggggcugguuaguggccucaggaaguacgguugcuaugacagagcagcugcagaugggcuuugggauaaccgugcaauacggaacugauaccaacagcguaugcccaaagcuagaguucgcgaaugacacaaaaaucgcaucgcagcucgguaacugugucgaauauucccuguacggcgugucugggcguggaguuuuucagaauugcaccgccgugggcguccgccagcaaagauucguguaugaugcuuaccagaaccuuguagguuauuacagcgacgaugggaacuacuauuguuugagggccugcgugucaguuccggucagugugauuuacgacaaggagacuaagacacaugcaacgcuguuuggcuccguggccugugaacacaucucuagcaccaugucccaguauucacggagcacucgaaguaugcucaaacgcagagauucuacauacggaccccugcagaccccugucggcugcguucuugggcugguaaauuccagcuuguucguggaggacuguaagcucccacugggacaaucguuaugcgcucugcccgauacaccuucaacucuaaccccauga

SEQ ID NO: 1859 - RNA, 2244 nt, Artificial Sequence; identical to SEQ ID NO: 1852
  derived and/or modified CDS sequence (opt3) from MERS-CoV__AGV08467__S1

SEQ ID NO: 1860 - RNA, 2244 nt, Artificial Sequence; identical to SEQ ID NO: 1852
  derived and/or modified CDS sequence (opt3) from MERS-CoV__AGV08492__S1

SEQ ID NO: 1861 - RNA, 2244 nt, Artificial Sequence
  derived and/or modified CDS sequence (opt3) from MERS-CoV__AGV08584__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugccugggaggacggcgauuacuaccggaaacagcucuccccucuggaaggugggggcugguuagucgcuucaggaaguacgguggcgaugacagagcagcugcagaugggcuuugggauaaccguucaauauggaacugacaccaacagcgugugcccaaagcuagaguucgcaaaugauacaaaaaucgccucgcagcucgguaacuguguagaauacucccuguauggcgucucugggcguggaguguuucagaauugcaccgcuguuggcgugcgccagcaaagauucgucuacgacgccuaucagaaccuuguggguuacuauagcgaugacgggaacuacuacuguuugagggcaugcguaucagugccgguuagugucauuuaugauaaggagacuaagacacaugccacgcuguuuggcuccguggcuugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcccugcccgacacaccuucaacucuaaccccauga

SEQ ID NO: 1862 - RNA, 2244 nt, Artificial Sequence
  derived and/or modified CDS sequence (opt3) from MERS-CoV__AHB33326__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccuacucgacuggaacagugaucauuucacccagcaccagugcuacgauccgcaaaauuuacccugcauucaugcugggcuccucuguaggcaauuuuagcgaugggaagaugggacgauucuuuaaccauacucuaguucuccugccagacgguuguggcacccuucugcgugccuucuauugcaucuuggagcccagauccgggaaucacuguccugcuggaaacucauacacaaguuuugccacuuaucauaccccagcgacagauugcagcgacggcaauuacaacaggaaugcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaauagcguaugcccaaagcuagaguucgcgaacgauacaaaaaucgcaucgcagcucgguaauugugucgaauauucccuguacggcgugucugggcguggaguuuuucagaacugcaccgccgugggcguccgccagcaaagauucguguaugacgcuuaccagaaucuuguagguuauuacagcgaugacgggaacuacuauuguuugagggccugcgugucaguuccggucagugugauuuacgauaaggagacuaagacacaugcaacgcuguuuggcuccguggccugugaacacaucucuagcaccaugucccaguauucacggagcacucgaaguaugcucaaacgcagagacucuacauacggaccccugcagaccccugucggcugcguucuugggcuggugaacuccagcuuguucguggaggauuguaagcucccacugggacaaucguuaugcgcucugcccgacacaccuucaacucuaaccccauga

SEQ ID NO: 1863 - RNA, 2244 nt, Artificial Sequence
  derived and/or modified CDS sequence (opt3) from MERS-CoV__AHC74088__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguuuugcuggaccuaucucucaguucaacuacaaacagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccauga

SEQ ID NO: 1864 - RNA, 2244 nt, Artificial Sequence
  derived and/or modified CDS sequence (opt3) from MERS-CoV__AHI48528__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccccggcaauagcuagcaauuguuauuccucucucauucuugauuacuucucguauccucugagcaugaaguccgacuugucagugaguucugccggacccaucagccaguuuaacuacaaacaguccuucucaaauccaaccugccuaauccugguaacaguuccucacaaccucacuaccauuacaaagccccugaaauauagcuacaucaauaagugcucuagacuucuguccgaugacaggaccgaagugccacaguuggucaacgcuaaucaauauagucccugugugagcauugucccuucuacugugugggaggacggcgauuacuaccggaaacagcucuccccacuggaaggugggggcugguuaguugccucaggaaguacgguggcaaugacagagcagcugcagaugggcuuugggauaaccguacaauauggaacugacaccaacagcgucugcccgaagcuagaguucgccaaugauacaaaaaucgcuucgcagcucgguaacuguguggaauacucccuguauggcguuucugggcguggaguguuucagaauugcaccgcggucggcgugcgccagcaaagauucguauacgacgcauaucagaaccuuguggguuacuauagcgaugacgggaacuacuacuguuugagggccugcguuucaguccccgugagugugauuuaugauaaggagacuaagacacaugcuacgcuguuuggcuccgucgccugugaacacaucucuagcaccaugucccaguacucacggagcacucgaaguaugcucaaacgcagagacucuacauauggaccucugcagaccccaguuggcugcgugcuugggcugguaaauuccagcuuguucguggaggauuguaagcucccccugggacaaucguuaugcgcacugccugacacaccaucaacucuaacccccuga

SEQ ID NO: 1865 - RNA, 2244 nt, Artificial Sequence; identical to SEQ ID NO: 1852
  derived and/or modified CDS sequence (opt3) from MERS-CoV__AHI48550__S1

SEQ ID NO: 1866 - RNA, 2244 nt, Artificial Sequence
  derived and/or modified CDS sequence (opt3) from MERS-CoV__AHI48583__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacguguucaaggcugaugggauuaucuauccccagggaaggaccuacaguaacauuacaaucacuuaucaggguuuguuuccuuaccagggcgaccauggggauauguaugucuacagcgcaggacacgccaccggcacaaccccacaaaaauuauucguggcgaauuauucccaggacguuaagcaguuugcuaacgguuucgugguccggauaggggccgcagccaauucuacuggaacagugaucauuucgcccucaaccagcgcuacgauccgcaaaauuuacccugcauuuaugcugggcaguuccguaggcaacuucucugaugggaagaugggacgauuuuucaaucauacucuaguucuccugccagacgguuguggcacccuucugcgugccuuuuacugcaucuuggagcccagaagcgggaaccacuguccugcuggaaauuccuauacaucauucgccacuuaccauaccccagcgacagauugcagugacggcaacuauaauaggaacgcaagccucaauucuuucaaggaauacuuuaaccugcggaauuguaccuucauguauacguacaacauaacugaggaugaaauucuggagugguuugguaucacacagaccgcccaaggggugcaccucuucuccucacgcuaugucgacuuauacggaggcaauauguuucaguucgcuacucugccgguguacgacacaauuaaauauuacagcaucaucccccacaguauuagaucuauacaguccgauaggaaggccugggcagcuuuuuauguguacaaacuucagccuuugaccuuccugcuagacuuuagcgucgauggcuauauccggcgcgccauugacugcggguucaacgaucucucgcaacugcauuguucuuacgaguccuuugacguugaaucaggaguguauaguguaagcuccuucgaggcgaagccaucugguagcguggucgaacaggccgagggcguggagugcgauuuuucaccccuucugagugggacgccuccacagguuuacaacuucaaacgauugguguucaccaauuguaacuacaaucucacaaagcuguuaucccuguuuagcgucaacgacuucacuugcucucaaaucucacccgcagcuauagccaguaauuguuauagcucccucauucuugauuacuuuucuuauccgcugucgaugaaaagcgacuuguccgugucaagugcuggaccuaucucucaguucaacuacaagcagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccauga

SEQ ID NO: 1867 - RNA, 2244 nt, Artificial Sequence; identical to SEQ ID NO: 1852
  derived and/or modified CDS sequence (opt3) from MERS-CoV__AHI48605__S1

SEQ ID NO: 1868 - RNA, 2244 nt, Artificial Sequence; identical to SEQ ID NO: 1854
  derived and/or modified CDS sequence (opt3) from MERS-CoV__AHY21469__S1

SEQ ID NO: 1869 - RNA, 2244 nt, Artificial Sequence
  derived and/or modified CDS sequence (opt3) from MERS-CoV__AHZ64057__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucuucucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccauga

SEQ ID NO: 1870 - RNA, 2244 nt, Artificial Sequence; identical to SEQ ID NO: 1852
  derived and/or modified CDS sequence (opt3) from MERS-CoV__AID50418__S1

SEQ ID NO: 1871 - RNA, 2244 nt, Artificial Sequence; identical to SEQ ID NO: 1852
  derived and/or modified CDS sequence (opt3) from MERS-CoV__AID55068__S1

SEQ ID NO: 1872 - RNA, 2244 nt, Artificial Sequence
  derived and/or modified CDS sequence (opt3) from MERS-CoV__AID55073__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccauga

SEQ ID NO: 1873 - RNA, 2244 nt, Artificial Sequence
  derived and/or modified CDS sequence (opt3) from MERS-CoV__AIY60528__S1
augauccacagcguguuccugcucauguuucuucugacccccacagaguccuacgucgacguuggcccugauucuuucaagucagccugcauugaaguggacauacagcaaaccuuuuucgauaaaacguggccaagaccgaucgacguaaguaaggcugaugggauuaucuauccccagggaaggaccuacagcaacauuacaaucacuuaucaggguuuguuuccuuaccagggcgaccauggggauauguauguguacuccgcaggacacgccaccggcacaaccccacaaaaauuauucgucgcgaauuauucucagaacgugaagcaguuugcuaaugguuucguugugcggauaggggccgcagccaacucgacuggaacagucaucauuucacccagcaccagugcuacgauccgcaaaauuuacccugcauuuaugcugggcuccucugugggcaauuucagcgacgggaagaugggacgauuuuucaaccauacucuaguacuccugccagaugguuguggcacccuucugcgugccuuuuacugcaucuuggagcccagauccgggaaucacuguccugcuggaaacucauauacaaguuucgccacuuaccauaccccagcgacagacugcagcgauggcaauuauaacaggaaugcaucucucaacuccuucaaggaauacuuuaaucugcggaacuguaccuucauguauacguacaauauaacugaggacgaaauucuggagugguuugguaucacacagaccgcccaagggguucaccucuucucaagccgcuauguggauuuauacggaggcaacauguuucaguucgcuacucugccggucuacgacacaauuaaauauuacaguaucaucccccacucuauuagauccauacagagcgacaggaaggccugggcagcuuuuuauguguacaaacuucagccuuugaccuuccugcuagauuuuucgguggacggcuauauccggcgcgccauugauugcggguucaacgaccucucucaacugcauuguuccuacgagucauuugaugucgaaaguggaguuuauagcguguccucuuucgaggcgaagccaagcgguucaguaguggaacaggccgagggcgucgagugcgacuuuaguccccuucuguccgggacgccuccacagguguacaauuucaaacgauugguuuucaccaacuguaauuacaaccucacaaagcuguuaagccuguuuucugugaaugauuucacuugcucacaaaucagucccgcagcuauagccagcaacuguuauuccucucucauucuugacuacuuuucguauccgcugagcaugaaguccgauuugucagucaguucugcuggaccuaucagccaguucaauuacaaacaguccuuuucaaaccccacuugccuaauccuggccacagugccacacaaucucacuaccauuacaaagccucugaaauauagcuacaucaacaagugcucuagacuucuguccgacgauaggaccgaaguaccccaguugguuaaugcaaaccaauauaguccaugugugagcauuguccccucuacugugugggaggacggcgacuacuaccggaaacagcucuccccucuggaaggugggggcugguuagucgccucaggaaguacgguggcuaugacagagcagcugcagaugggcuucgggauaaccguucaauauggaacugauaccaauagcgugugcccaaagcuagaauuugcgaacgacacaaaaaucgcaucgcagcucgguaauuguguagaguacucccuguauggcgucucugggcguggaguguuccagaacugcaccgccguuggcgugcgccagcaaagauuugucuacgaugcuuaucagaaccuuguggguuacuauagcgacgaugggaauuacuacuguuugagggccugcguaucagugccgguuagugucauuuaugacaaggagacuaagacacaugcaacgcuguucggcuccguggccugugaacacaucucuagcaccaugucccaguacucacggagcacucgaaguaugcucaaacgcagagauucuacauauggaccccugcagaccccugugggcugcguccuugggcugguuaacuccagcuuguuuguggaggacuguaagcucccacugggacaaucguuaugcgcucugcccgauacaccuucaacucuaaccccauga

SEQ ID NO: 1874 - RNA, 2244 nt, Artificial Sequence
  derived and/or modified CDS sequence (opt3) from MERS-CoV__AIY60558__S1
augauccacagcguguuccugcucauguuucuucugacccccacagaguccuacgucgacguuggcccugauucuuucaagucagccugcauugaaguggacauacagcaaaccuuuuucgauaaaacguggccaagaccgaucgacguaaguaaggcugaugggauuaucuauccccagggaaggaccuacagcaacauuacaaucacuuaucaggguuuguuuccuuaccagggcgaccauggggauauguauguguacuccgcaggacacgccaccggcacaaccccacaaaaauuauucgucgcgaauuauucucaggacgugaagcaguuugcuaacgguuucguugugcggauaggggccgcagccaauucgacuggaacagucaucauuucacccagcaccagugcuacgauccgcaaaauuuacccugcauuuaugcugggcuccucugugggcaacuucagcgaugggaagaugggacgauuuuucaaucauacucuaguacuccugccagacgguuguggcacccuucugcgugccuuuuacugcaucuuggagcccagauccgggaaccacuguccugcuggaaauucauauacaaguuucgccacuuaccauaccccagcgacagauugcagcgacggcaacuauaauaggaacgcaucucucaauuccuucaaggaauacuuuaaccugcggaauuguaccuucauguauacguacaacauaacugaggaugaaauucuggagugguuugguaucacacagaccgcccaagggguucaccucuucucaagccgcuauguggacuuauacggaggcaauauguuucaguucgcuacucugccggucuacgacacaauuaaauauuacaguaucaucccccacucuauuagauccauacagagcgauaggaaggccugggcagcuuuuuauguguacaaacuucagccuuugaccuuccugcuagacuuuucgguggauggcuauauccggcgcgccauugacugcggguucaacgaucucucucaacugcauuguuccuacgagucauuugacgucgaaaguggaguuuauagcguguccucuuucgaggcgaagccaagcgguucaguaguggaacaggccgagggcgucgagugcgauuuuaguccccuucuguccgggacgccuccacagguguacaacuucaaacgauugguuuucaccaauuguaacuacaaucucacaaagcuguuaagccuguuuucugugaacgacuucacuugcucacaaaucagucccgcagcuauagccagcaauuguuauuccucucucauucuugauuacuuuucguauccgcugagcaugaaguccgacuugucagucaguucugcuggaccuaucagccaguucaacuacaaacaguccuuuucaaaucccacuugccuaauccuggccacagugccacacaaccucacuaccauuacaaagccucugaaauauagcuacaucaauaagugcucuagacuucuguccgaugacaggaccgaaguaccccaguugguuaacgcaaaucaauauaguccaugugugagcauuguccccucuacugugugggaggacggcgauuacuaccggaaacagcucuccccucuggaaggugggggcugguuagucgccucaggaaguacgguggcuaugacagagcagcugcagaugggcuucgggauaaccguucaauauggaacugacaccaacagcgugugcccaaagcuagaauuugcgaaugauacaaaaaucgcaucgcagcucgguaacuguguagaguacucccuguauggcgucucugggcguggaguguuccagaauugcaccgccguuggcgugcgccagcaaagauuugucuacgacgcuuaucagaaccuuguggguuacuauagcgaugacgggaacuacuacuguuugagggccugcguaucagugccgguuagugucauuuaugauaaggagacuaagacacaugcaacgcuguucggcuccguggccugugaacacaucucuagcaccaugucccaguacucacggagcacucgaaguaugcucaaacgcagagacucuacauauggaccccugcagaccccugugggcugcguccuugggcugguuaauuccagcuuguuuguggaggauuguaagcucccacugggacaaucguuaugcgcucugcccgacacaccuucaacucuaaccccauga

SEQ ID NO: 1875 - RNA, 2244 nt, Artificial Sequence; identical to SEQ ID NO: 1852
  derived and/or modified CDS sequence (opt3) from MERS-CoV__AIZ74450__S1

SEQ ID NO: 1876 - RNA, 2244 nt, Artificial Sequence
  derived and/or modified CDS sequence (opt3) from MERS-CoV__AJD81440__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuaaccccucaaccagcgcuacgauccgcaaaauuuacccugcauucaugcugggcaguuccguaggcaauuuuucugaugggaagaugggacgauucuuuaaccauacucuaguucuccugccagacgguuguggcacccuucugcgugccuucuacugcaucuuggagcccagaagcgggaaucacuguccugcuggaaacuccuauacaucauuugccacuuaccauaccccagcgacagauugcagugacggcaauuauaacaggaaugcaagccucaacucuuucaaggaauacuucaaucugcggaacuguaccuuuauguauacguacaauauaacugaggaugaaauucuggagugguucgguaucacacagaccgcccaaggggugcaccucuuuuccucacgcuaugucgacuuauacggaggcaacauguuccaguuugcuacucugccgguguacgacacaauuaaauauuacagcaucaucccccacaguauuagaucuauacaguccgauaggaaggccugggcagcuuucuauguguacaaacuucagccuuugaccuuucugcuagacuucagcgucgauggcuauauccggcgcgccauugacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaauuuuaaacgauugguguucaccaacuguaauuacaaccucacaaagcuguuaucccuguucagcgucaaugacuuuacuugcucucaaaucucacccgcagcuauagccaguaacuguuauagcucccucauucuugauuacuucucuuauccgcugucgaugaagagugacuuguccgugucaagugcuggaccuaucucucaguuuaauuacaaacagagcuucuccaacccaaccugccuaauccuggccacaguaccccacaaucucacuaccauuacaaagccucugaaauauucauacaucaacaagugcagcagacuucugucugaugacaggaccgaaguuccccaguuggugaaugcaaaccaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuuugggauaaccgugcaauauggaacugacaccaauaguguaugcccaaagcuagaguucgcgaacgauacaaaaaucgcaagccagcucgguaauugugucgaauacucgcuguauggcguguccgggcguggaguuuuucagaacugcaccgccgugggcguccgccagcaaagauucguguacgacgcuuaucagaaccuuguagguuacuauucugaugacgggaauuacuacuguuugagggccugcgugagcguuccggucucagugauuuaugauaaggagacuaagacacaugcaacgcuguuuggcaguguggccugugaacacaucuccucuaccaugagccaguacucccggucaacucgaagcaugcucaaacgcagagacaguacauauggaccccugcagaccccugucggcugcguucuugggcuggugaacucuuccuuguucguggaggauuguaagcucccacugggacaaagccuuugcgcucugcccgacacaccuucgacucuaaccccauga

SEQ ID NO: 1877 - RNA, 2244 nt, Artificial Sequence
  derived and/or modified CDS sequence (opt3) from MERS-CoV__AKI29284__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaauuugcgaaugauacaaaaaucgcaucgcagcucgguaacugugucgaguacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1878 - RNA, 2244 nt, Artificial Sequence
  derived and/or modified CDS sequence (opt3) from MERS-CoV__AKL59401__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcacccgcgcuacgauccgaaaaauuuacccugcauucaugcugggcaguuccguaggcaacuuuucugaugggaagaugggacguuucuuuaaucauacucuaguucuccugccagacgguuguggcacccuucugagagccuucuacugcaucuuggagcccaggagcgggaaccacuguccugcuggaaauuccuauacaucauuugccacuuaccauaccccagcgacagauugcagugacggcaacuauaaucggaacgcaagccucaauucuuucaaggaauacuucaaccugcgcaauuguaccuuuauguauacguacaacauaacugaggaugaaauucuggagugguucgguaucacacagaccgcccaaggggugcaccucuuuuccucaagauaugucgacuuauacggaggcaauauguuccaguuugcuacucugccgguguacgacacaauuaaauauuacagcaucaucccccacaguauuaggucuauacaguccgaucggaaggccugggcagcuuucuauguguacaaacuucagccuuugaccuuucugcuagacuucagcgucgauggcuauauccgccgagccauugacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaacuuuaaaagauugguguucaccaauuguaacuacaaucucacaaagcuguuaucccuguucagcgucaacgacuuuacuugcucucaaaucucacccgcagcuauagccaguaauuguuauagcucccucauucuugauuacuucucuuauccgcugucgaugaagagugacuuguccgugucaagugcuggaccuaucucucaguuuaacuacaaacagagcuucuccaauccaaccugccuaauccuggccacaguaccccacaaccucacuaccauuacaaagccucugaaauauucauacaucaauaagugcagcaggcuucugucugaugaccggaccgaaguuccccaguuggugaacgcaaaucaauauuccccaugugucaguauucuccccagcacugugugggaggacggcgauuacuaccguaaacagcugucuccuuuagaaggugggggcuggcuggucgccuccggaucaacgguggcuaugacagagcagcuacagaugggcuuugggauaaccguucaauauggaacugacaccaacagugugugcccaaagcucgaguucgcgaaugauacaaaaaucgcaagccagcuggguaacuguguagaauacucgcuuuauggcgucuccgggcgcggaguguuucagaauugcaccgccguuggcgugagacagcaaagguucgucuacgacgcuuaucagaacuugguggguuacuauucugaugacgggaacuacuacugucugcgggccugcguaagcgugccgguuucagucauuuaugauaaggagacuaagacacaugcaacgcucuuuggcaguguggccugugaacacaucuccucuaccaugagccaguacucccgaucaacucgcagcaugcugaaaagaagggacaguacauauggaccccuucagaccccugugggcugcguccugggguugguuaauucuucccucuucguggaggauuguaagcugccauuaggacaaagccugugcgcucuacccgacacaccuucgacucucaccccauga

SEQ ID NO: 1879 - RNA, 2244 nt, Artificial Sequence
  derived and/or modified CDS sequence (opt3) from MERS-CoV__AKM76229__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaccacuaacucccuga

SEQ ID NO: 1880 - RNA, 2244 nt, Artificial Sequence
  derived and/or modified CDS sequence (opt3) from MERS-CoV__AKM76239__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaauugccccagcucguuaacgcaaaucaauauaguccaugugugagcauuguccccucuacugugugggaggacggcgauuacuaccggaaacagcuguccccuuuagaaggugggggcuggcuggucgccucaggaaguacgguggcuaugacagagcagcuacagaugggcuuugggauaaccguucaauauggaacugacaccaacagcgugugcccaaagcucgaguucgcgaaugauacaaaaaucgcaucgcagcuggguaacuguguagaauacucccuuuauggcgucucugggcguggaguguuucagaauugcaccgccguuggcgugcgccagcaaagauucgucuacgacgcuuaucagaacuugguggguuacuauagcgaugacgggaacuacuacugucugagggccugcguaucagugccgguuagugucauuuaugauaaggagacuaagacacaugcaacgcucuuuggcuccguggccugugaacacaucucuagcaccaugucccaguacucacggagcacucgaaguaugcugaaacgcagagacucuacauauggaccccuucagaccccugugggcugcguccugggguugguuaauuccagccucuucguggaggauuguaagcugccauuaggacaaucgcugugcgcucuacccgacacaccuucaacucucaccccauga

SEQ ID NO: 1881 - RNA, 2244 nt, Artificial Sequence
  derived and/or modified CDS sequence (opt3) from MERS-CoV__AKN11072__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcacugugcccucuacggucugggaggacggcgauuacuaccggaaacagcucuccccucuggaaggugggggcugguuaguggccucaggaaguacaguugcuaugaccgagcagcugcagaugggcuuugggauuacugugcaauauggaaccgacacaaacagcguaugcccaaagcuagaguucgcgaaugauaccaaaauagcaucgcagcucgguaacugugucgaauacucccuguauggcgugucugggcguggaguuuuucagaauugcacugccgugggcguccgccagcaaagauucguguacgacgcuuaucagaaccuuguagguuacuauagcgaugacgggaacuacuacuguuugagggccugcgugucaguuccggucagugugaucuaugauaaggagacaaagacgcaugcaacccuguuuggcuccguggccugugaacacauuucuagcacuaugucccaguacucacggagcacacgaaguaugcucaaacgcagagacucuaccuauggaccccugcagacaccugucggcugcguucuugggcugguaaauuccagcuuguucguggaggauuguaagcucccacugggacaaucguuaugcgcucugcccgacacuccuucaacccuaacgccauga

SEQ ID NO: 1882 - RNA, 2244 nt, Artificial Sequence
  derived and/or modified CDS sequence (opt3) from MERS-CoV__AKN11074__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcacugugcccucuacggucugggaggacggcgauuacuaccggaaacagcucuccccucuggaaggugggggcugguuaguggccucaggaaguacaguugcuaugaccgagcagcugcagaugggcuuugggauuacugugcaauauggaaccgacacaaacagcguaugcccaaagcuagaguucgcgaaugauaccaaaauagcaucgcagcucgguaacugugucgaauacucccuguauggcgugucugggcguggaguuuuucagaauugcacugccgugggcguccgccagcaacauuucguguacgacgcuuaucagaaccuuguagguuacuauagcgaugacgggaacuacuacuguuugagagccugcgugucaguuccggucagugugaucuaugauaaggagacaaagacgcacgcaacccuguuuggcuccguggccugugaacacauuucuagcacuaugucccaguacucaaggagcacacggaguaugcucaaacgacgcgacucuaccuauggaccccugcagacaccugucggcugcguucuugggcugguaaauuccagcuuguucguggaggauuguaagcucccacugggacaaucguuaugcgcucugcccgacacuccuucaacccuaacgccauga

SEQ ID NO: 1883 - RNA, 2244 nt, Artificial Sequence
  derived and/or modified CDS sequence (opt3) from MERS-CoV__AKN24803__S1
auggugcacagcgucuuccugcucauguuucuucugacccccacagaguccuacguugacgugggcccugauucuguaaagucagccugcaucgaaguggacauucagcaaacuuucuuugauaaaacguggccaagaccgauagacgucaguaaggcugaugggaucauuuauccccagggaaggaccuacagcaacaucacaauuacuuaucaggguuuguucccuuaccagggcgaccauggggauauguauguguacuccgcaggacacgccaccggcacaaccccacaaaaauuauuuguugcgaauuauucucaggacgugaagcaguucgcuaacgguuuugucgugcggaucggggccgcagccaauucgacuggaacaguaauaaucucacccagcaccagugcuacgauucgcaaaaucuacccugcauucaugcugggcuccucuguuggcaacuuuagcgaugggaagaugggacgauucuuuaaucauacucuagugcuccugccagacgguuguggcacccuucugcgugccuucuacugcauuuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacaucacugaggaugaaauacuggagugguucgguauuacacagaccgcccaagggguccaccucuuuucaagccgcuauguggacuuauacggaggcaauauguuccaguuugcuacucugccgguguacgacacaaucaaauauuacaguauuaucccccacucuaucagauccauucagagcgauaggaaggccugggcagcuuucuaugucuacaaacuucagccuuugaccuuucugcuagacuucucgguugauggcuauauacggcgcgccaucgacugcggguuuaacgaucucucucaacugcauuguuccuacgagucauucgacguggaaaguggaguauauagcguguccucuuuugaggcgaagccaagcgguucagucguggaacaggccgagggcguugagugcgauuucaguccccuucuguccgggacgccuccacagguguacaacuuuaaacgauuggucuucaccaauuguaacuacaauuucacaaagcuccugagcuuauuuucugugaacgacuucacuugcucacaaauuagucccgcagcuaucgccagcaauuguuauuccucucugauacucgauuacuuuucguauccgcuuagcaugaaguccgaccugucaguaaguucugcuggaccuauuagccaguucaacuacaaacaguccuuuucaaauccaaccugcuugauccuagccacaguuccccacaaccugacuaccaucacaaagccucucaaauauagcuacauuaauaagugcucuagacugcuuuccgaugacaggaccgaagugccccagcuggucaacgcaaaucaauauaguccaugugugagcaucguccccucuacugugugggaggacggcgauuacuaccggaaacaguuguccccucucgaaggugggggcuggcugguugccucaggaaguacgguggcuaugacagagcaguuacagaugggcuucgggauuaccguacaauauggaacugacaccaacagcgucucgccaaagcuggaauuugcgaaugauacaaaaauagcaucccagcuagguaacugcguggaguacucucucuauggcguuagcgggcguggaguguuccagaauuguaccgccgucggcgugcgccagcaaagauuuguauacgacgcuuaucagaaccugguggguuacuauucagaugacgggaacuacuacugccuuagggccuguguuagugucccgguguccgugaucuaugauaaggagacuaagacacaugcaacguuguucggcucugucgccugcgaacacauuagcuccaccaugucacaguacagccggaguacucgaucuaugcugaaacgcagagacuccacauauggaccccuccagaccccuguuggcugugugcuggggcuugugaauagcucgcuguuuguagaggauugcaaguugccacucggacaaucacugugugcuuuacccgacacaccuucuacucugaccccauga

SEQ ID NO: 1884 - RNA, 2244 nt, Artificial Sequence
  derived and/or modified CDS sequence (opt3) from MERS-CoV__AKN24812__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucugcguguauaaacuucagccuuugaccuuucugcuagacuucucggucgauggcuacauccggcgcgccauugacuguggguuuaacgaucucucucaacugcauugcuccuaugagucauucgacguugaaaguggaguguacagcguauccucuuuugaggcgaagccaagcgguucaguggucgaacaggccgagggcguggagugugauuucaguccccuucuguccgggacgccuccacagguuuauaacuuuaaacgauugguguucaccaauugcaacuacaauuucacaaagcuccugagcuuauuuucugucaacgacuucacuuguucacaaaucagucccgcagcuauagccagcaauugcuacuccucucugauucucgauuauuuuucguacccgcuuagcaugaaguccgaccugucagugaguucugcuggaccuaucagccaguucaacuauaaacaguccuuuucaaauccaaccugcuugauccuagccacaguaccccacaaccugacuaccauuacaaagccucucaaauacagcuauaucaauaaguguucuagacugcuuuccgaugacaggaccgaaguuccccagcuggugaacgcaaaucaauacaguccaugcgucagcauugugcccucuacugucugggaggacggcgauuauuaccggaaacaguuguccccucucgaaggugggggcuggcugguggccucaggaaguacgguugcuaugacagagcaguuacagaugggcuucgggauaaccgugcaauacggaacugacaccaacagcguauguccaaagcuggaauuugcgaaugauacaaaaaucgcaucgcagcuagguaacugcgucgaguauucccucuacggcgugucugggcguggaguuuuccagaauuguaccgccgugggcguccgccagcaaagauuuguguaugacgcuuaccagaaccugguagguuauuacagcgaugacgggaacuauuacugccuuagggccugugugucaguuccggucagugugauuuacgauaaggagacuaagacacaugcaacguuguucggcuccguggccugcgaacacaucucuagcaccaugucccaguauucacggagcacucgaaguaugcugaaacgcagagacucuacauacggaccccuccagaccccugucggcuguguucuggggcuuguaaauuccagccuguuuguggaggauugcaaguugccacucggacaaucgcugugugcuuuacccgacacaccuucaacucugaccccauga

SEQ ID NO: 1885 - RNA, 2244 nt, Artificial Sequence
  derived and/or modified CDS sequence (opt3) from MERS-CoV__AKN24830__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaauuucacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaccaacgguugcuaugacagagcaguuacagaugggcuucgggauaaccgugcaauauggaacugacaccaacaguguaugcccgaagcuggaauuugcgaaugauacaaaaaucgcaagccagcuagguaacugugucgaguacucgcucuauggcguguccgggcguggaguuuuccagaauugcaccgccgugggcguccgccagcaaagauuuguguacgacgcuuaucagaaccugguagguuacuauucugaugacgggaacuacuacugucuuagggccugcgugagcguucccgucucagugauuuaugauaaggagacuaagacacaugcaacguuguucggcaguguggccugugaacacaucuccucuaccaugagccaguacucccggucaacucgaagcaugcugaaacgcagagacaguacauauggaccucuccagaccccagucggcugcguucuggggcuugugaauaguucccuguuuguggaggauuguaaguugccccucggacaaagccugugcgcuuuaccugacacaccaucgacucugacccccuga

SEQ ID NO: 1886 - RNA, 2244 nt, Artificial Sequence; identical to SEQ ID NO: 1852
  derived and/or modified CDS sequence (opt3) from MERS-CoV__ALB08257__S1

SEQ ID NO: 1887 - RNA, 2244 nt, Artificial Sequence
  derived and/or modified CDS sequence (opt3) from MERS-CoV__ALB08311__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggauaugccaccggcacaaccccacaaaaauuauuuguggcgaauuacucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucacacucuaguucuccugccagacgguuguggcacccuucugcgugccuucuauugcaucuuggagcccagauccgggaaccauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgauggcaggaccgaaguuccccaguuggugaacgcaaaucaauacaguccaugugucagcauugugcccucuacugucugggaggacggugacuacuaucggaaacagcucuccccucuggaagggggcggaugguuaguggccucaggcaguacgguugcuaugacagagcagcugcagaugggguuuggaauaaccgugcaauacgguacugauaccaacagcguaugcccaaagcuagaguucgcgaaugacacaaaaaucgcaucgcagcucggcaacugugucgaauauucccuguacggggugucuggacguggcguuuuucagaauugcaccgccguggguguccgccagcaaagauucguguaugaugcuuaccagaaccuuguaggguauuacagcgacgauggcaacuacuauuguuugagggccugcgugucaguuccggucagugugauuuacgacaaggagacuaagacacacgcaacgcuguuuggauccguggccugugaacauaucucuagcaccaugucccaguauucacggagcacucgaaguaugcucaaacgcagagauucuacauacggcccccugcagaccccugucgggugcguucuuggacugguaaauuccagcuuguucguggaggacuguaagcucccacugggucaaucguuaugcgcucugcccgauacaccuucaacucuaaccccauga

SEQ ID NO: 1888 - RNA, 2244 nt, Artificial Sequence; identical to SEQ ID NO: 1887
  derived and/or modified CDS sequence (opt3) from MERS-CoV__ALB08322__S1

SEQ ID NO: 1889 - RNA, 2244 nt, Artificial Sequence
  derived and/or modified CDS sequence (opt3) from MERS-CoV__ALD51904__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcuggugaauaguagcuuguucguggaggauuguaagcucccacugggacaaucguuaugcgcucugcccgacacaccuucaacucuaaccccauga

SEQ ID NO: 1890 - RNA, 2244 nt, Artificial Sequence
  derived and/or modified CDS sequence (opt3) from MERS-CoV__ALJ54446__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauuuuuauacaucauucgccacuuaccauaccccagcgacagauugcagugacggcaacuauaauaggaacgcaagccucaauucuuucaaggaauacuuuaaccugcggaauuguaccuucauguauacguacaacauaacugaggaugaaauucuggagugguuugguaucacacagaccgcccaaggggugcaccucuucuccucacgcuaugucgacuuauacggaggcaauauguuucaguucgcuacucugccgguguacgacacaauuaaauauuacagcaucaucccccacaguauuagaucuauacaguccgauaggaaggccugggcagcuuuuuauguguacaaacuucagccuuugaccuuccugcuagacuuuagcgucgauggcuauauccggcgcgccauugacugcggguucaacgaucucucgcaacugcauuguucuuacgaguccuuugacguugaaucaggaguguauaguguaagcuccuucgaggcgaagccaucugguagcguggucgaacaggccgagggcguggagugcgauuuuucaccccuucugagugggacgccuccacagguuuacaacuucaaacgauugguguucaccaauuguaacuacaaucucacaaagcuguuaucccuguuuagcgucaacgacuucaucugcucucaaauaucacccgcagcuauugccaguaauuguuauagcucccucauccuugauuacuuuucuuauccgcugucgaugaaaagcgacuuguccgugucaagugcuggaccuaucucucaguucaacuacaagcagagcuuuuccaaucccacuugccuaauucuggccaccguaccacacaaccucacaacuaucaccaagccucugaaauauucauacauuaauaagugcagcagacuucugucugaugacaggacagaaguuccccaguuggugaacgcaaaucaauauuccccaugugucaguauagugcccagcaccgucugggaggacggcgauuacuaccggaaacagcucucuccucuggaaggugggggcugguuaguggccuccggaucaacuguugcuaugacggagcagcugcagaugggcuucgggaucacagugcaauauggaaccgacacuaacaguguaugcccaaagcuagaauuugcgaaugauaccaaaauugcaagccagcucgguaacugugucgaguacucgcuguauggcguguccgggcguggaguuuuccagaauugcacagccgugggcguccgccagcaaagauuuguguacgacgcuuaucagaaccuuguagguuacuauucugaugacgggaacuacuacuguuugagggccugcgugagcguuccggucucagugaucuaugauaaggagaccaagacucaugcaacacuguucggcaguguggccugugaacacaucuccucuacgaugagccaguacucccggucaacccgaagcaugcucaaacgcagagacaguacuuauggaccccugcagacaccugucggcugcguucuugggcuggugaauagcuccuuguuuguggaggauuguaagcucccacugggacaaucuuuaugcgcucugcccgacaccccuucgacacuaacuccauga

SEQ ID NO: 1891 - RNA, 2244 nt, Artificial Sequence
  derived and/or modified CDS sequence (opt3) from MERS-CoV__ALJ54448__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaauacucaauucuuucaaggaauacuucaaccugcggaauuguaccuuuauguauacguacaacauuacugaggaugaaauccuggagugguucgguauuacacagaccgcccaaggggugcaccucuuuuccucacgcuaugucgacuuauacggaggcaauauguuccaguuugcuacucugccgguguacgacacaaucaaauauuacagcaucauuccccacaguauaagaucuauccaguccgauaggaaggccugggcagcuuucuauguguacaaacuucagccuuugaccuuucugcuagacuucagcgucgauggcuauauucggcgcgccaucgacugcggguuuaacgaucucucgcaacugcauuguucuuacgaguccuucgacguugaaucaggaguguauaguguaagcuccuuugaggcgaagccaucugguagcguggucgaacaggccgagggcguggagugcgauuucucaccccuucugagugggacgccuccacagguuuacaacuuuaaacgauugguguucaccaauuguaacuacaaucucacaaagcuguuaucccuguucagcgucaacgacuuuacuugcucucaaauaucacccgcagcuauugccaguaauuguuauagcucccucauccuugauuacuucucuuauccgcugucgaugaaaagcgacuuguccgugucaagugcuggaccuaucucucaguuuaacuacaagcagagcuucuccaauccaaccugccuaauucuggccacaguaccccacaaccucacuaccaucacaaagccucugaaauauucauacauuaauaagugcagcagacuucugucugaugacaggaccgaaguuccccaguuggugaacgcaaaucaauauuccccaugugucaguauagugcccagcacugucugggaggacggcgauuacuaccggaaacagcucucuccucuggaaggugggggcugguuaguggccuccggaucaacgguugcuaugacagagcagcugcagaugggcuuugggaucaccgugcaauauggaacugacaccaacaguguaugcccaaagcuagaguucgcgaaugauacaaaaauugcaagccagcucgguaacugugucgaauacucgcuguauggcguguccgggcguggaguuuuucagaauugcaccgccgugggcguccgccagcaaagauucguguacgacgcuuaucagaaccuuguagguuacuauucugaugacgggaacuacuacuguuugagggccugcgugagcguuccggucucagugaucuaugauaaggagacuaagacacaugcaacgcuguuuggcaguguggccugugaacacaucuccucuaccaugagccaguacucccggucaacucgaagcaugcucaaacgcagagacaguacauauggaccccugcagaccccugucggcugcguucuugggcugguaaauucuuccuuguucguggaggauuguaagcucccacugggacaaaguuuaugcgcucugcccgacacaccuucgacucuaaccccauga

SEQ ID NO: 1892 - RNA, 2244 nt, Artificial Sequence
  derived and/or modified CDS sequence (opt3) from MERS-CoV__ALJ54450__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauagguacgcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaauagcguaugcccaaagcuagaguucgcgaacgauacaaaaaucgcaucgcagcucgguaauugugucgaauauucccuguacggcgugucugggcguggaguuuuucagaacugcaccgccgugggcguccgccagcaaagauucguguaugacgcuuaccagaaucuuguagguuauuacagcgaugacgggaacuacuauuguuugagggccugcgugucaguuccggucagugugauuuacgauaaggagacuaagacacaugcaacgcuguuuggcuccguggccugugaacacaucucuagcaccaugucccaguauucacggagcacucgaaguaugcucaaacgcagagacucuacauacggaccccugcagaccccugucggcugcguucuugggcuggugaacuccagcuuguucguggaggauuguaagcucccacugggacaaucguuaugcgcucugcccgacacaccuucaacucuaaccccauga

SEQ ID NO: 1893 - RNA, 2244 nt, Artificial Sequence
  derived and/or modified CDS sequence (opt3) from MERS-CoV__ALJ54453__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaacuauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuacuauuguuugagggccugcgugucaguuccggucagugugauuuacgauaaggagacuaagacacacgcaacgcuguuuggcuccguggccugugaacauaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1894 - RNA, 2244 nt, Artificial Sequence
  derived and/or modified CDS sequence (opt3) from MERS-CoV__ALJ54455__S1
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgaugacaggaccgagguuccccaguuggugaacgccaaucaauauaguccaugugucagcauugugcccucuacugucugggaagacggcgauuacuaccggaaacagcucuccccucuggagggugggggcugguuaguggcuucaggaaguacgguugcgaugacagaacagcugcagaugggcuuugggauaaccgugcaauauggaacugacaccaacagcguaugcccaaagcuagaguucgcaaaugauacaaaaaucgccucgcagcucgguaacugugucgaauacucccuguauggcgugucugggcguggaguuuuucagaauugcaccgcugugggcguccgccagcaaagauucguguacgacgccuaucagaaccuuguagguuacuauagcgaugacgggaacuacuacuguuugagggcaugcgugucaguuccggucagugugauuuaugauaaggagacuaagacacaugccacgcuguuuggcuccguggcuugugagcacaucucuagcaccaugucccaguacucacggagcacucgaaguaaacucaagcgcagagacucuacauauggaccccugcagaccccugucggcugcguucuugggcugguaaauuccagcuuguucguggaagauuguaaacucccacugggacaaucguuaugcgcccugcccgacacaccuucaacucuaaagccauga

SEQ ID NO: 1895 - RNA, 2244 nt, Artificial Sequence
  derived and/or modified CDS sequence (opt3) from MERS-CoV__ALJ54456__S1
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgaugacaggaccgagguuccccaguuggugaacgccaaucaauauaguccaugugucagcauugugcccucuacugucugggaagacggcgauuacuaccggaaacagcucuccccucuggagggugggggcugguuaguggcuucaggaaguacgguugcgaugacagaacagcugcagaugggcuuugggauaaccgugcaauauggaacugacaccaacagcguaugcccaaagcuagaguucgcaaaugauacaaaaaucgccucgcagcucgguaacugugucgaauacucccuguauggcgugucugggcguggaguuuuucagaauugcaccgcugugggcguccgccagcaaagauucguguacgacgccuaucagaaccuuguagguuacuauagcgaugacgggaacuacuacuguuugagggcaugcgugucaguuccggucagugugauuuaugauaaggagacuaagacacaugccacgcuguuuggcuccguggcuugugagcacaucucuagcaccaugucccaguacucacggagcacucgaaguaugcucaaacgcagagacucuacauauggaccccugcagaccccugucggcugcguucuugggcugguaaauuccagcuuguucguggaagauuguaagcucccacugggacaaucguuaugcgcccugcccgacacaccuucaacucuaaaaccauga

SEQ ID NO: 1896 - RNA, 2244 nt, Artificial Sequence
  derived and/or modified CDS sequence (opt3) from MERS-CoV__ALJ54461__S1
augauccacagcguguuccugcucauguuucuucugacccccacagaguccuacgucgacguuggcccugauucugugaagccagccugcauugaaguagacauacagcaaacuuucuuugauaaaacguggccgagacccaucgacgugucaaaggcugaugggauuaucuauccucagggaaggaccuacaguaacauuacaaucacuuaucaggguuuguucccauaccagggcgaccauggggauauguaugucuacagcgcaggacacgccaccggcacaacuccccaaaaauuauuuguggcgaauuauucccaggacguuaagcaguucgcuaacgguuuugugguccggauaggggccgcagccaauucuaccggaacagugaucauuucgccuucaaccagcgcuacgauccgcaaaauuuacccagcauucaugcugggcaguuccguaggcaacuuuucugaugggaagaugggacgauucuuuaaucauacucuaguucuccugcccgacgguuguggcacccuucugcgugccuucuacugcaucuuggagccuagaagcgggaaccacuguccagcuggaaauuccuauacaucauuugccacuuaccauaccccggcgacagauugcagugacggcaacuauaauaggaacgcaagccucaauucuuucaaggaauacuucaaccugcggaauuguaccuuuauguauacguacaacauaacugaggaugaaauucuggagugguucgguaucacacagaccgcccaaggggugcaccucuuuuccucacgcuaugucgacuuauacggaggcaauauguuccaguuugcuacucugcccguguacgacacaauuaaauauuacagcaucaucccucacaguauuagaucuauacaguccgauaggaaggccugggcagcuuucuauguguacaaacuucagccauugaccuuucugcuagacuucagcgucgauggcuauauccggcgcgccauugacugcggguuuaacgaucucucgcaacugcauuguucuuacgaguccuucgacguugaaucaggaguguauaguguaagcuccuuugaggcgaagcccucugguagcguggucgaacaggccgagggcguggagugcgauuucucaccucuucugagugggacgccaccccagguuuacaacuuuaaacgauugguguucaccaauuguaacuacaaucucacaaagcuguuaucccuguucagcgucaacgacuuuacuugcucucaaaucucaccggcagcuauagccaguaauuguuauagcucccucauucuugauuacuucucuuauccucugucgaugaaaagcgacuuguccgugaccucagcuggacccaucagucaguuuaacuacaagcagucuuucagcaauccaacaugccuaauccuggccacuguaccucacaaccucaccacaauuaccaagccccugaaauauuccuacaucaauaagugcucaagacuucugagcgaugacaggacugaaguuccacaguuggugaacgcaaaucaauauucucccugugucuccauugugccuaguacggucugggaggacggcgauuacuaccggaaacagcucagcccacuggaaggugggggcugguuaguggccucuggauccacaguugcuaugaccgagcagcugcagaugggcuuugggauaacugugcaauauggaaccgacacaaacucaguaugcccgaagcuagaguucgcgaaugauaccaaaaucgcaagucagcucgguaacugugucgaauacagccuguauggcgugucggggcguggaguuuuucagaauugcacugccgugggcguccgccagcaaagauucguguacgacgcuuaucagaaccuuguagguuacuauuccgaugacgggaacuacuacuguuugagggccugcgugucuguucccgucagcgugauuuaugauaaggagacaaagacgcaugcaacccuguuuggcucaguggccugugaacacaucaguuccacuaugucucaguacagccgguccacacgaucaaugcucaaacgcagagacagcaccuauggaccucugcagacaagugucggcugcguucuugggcuggugaauagcuccuuguucguggaggauuguaagcucccacugggacaaucuuuaugcgcucugcccgacacuccuucgacccuaacgccauga

SEQ ID NO: 1897 - RNA, 2244 nt, Artificial Sequence
  derived and/or modified CDS sequence (opt3) from MERS-CoV__ALJ54468__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuaucugcucacaaauaagucccgcagcuauugccagcaauuguuauuccucucucauccuugauuacuucucguauccgcugagcaugaaguccgacuugucagugaguucugcuggaccuaucagccaguuuaacuacaaacaguccuucucaaaucccacuugccuaauucuggccaccguaccacacaaccucacaacuaucaccaagccucugaaauauagcuacauuaauaagugcucuagacuucuguccgaugacaggacagaaguuccccaguuggugaacgcaaaucaauauaguccaugugucagcauagugcccucuaccgucugggaggacggcgauuacuaccggaaacagcucuccccucuggaaggugggggcugguuaguggccucaggaaguacuguugcuaugacggagcagcugcagaugggcuuugggaucacagugcaauauggaaccgacacuaacagcguaugcccaaagcuagaguucgcgaaugauaccaaaauugcaucgcagcucgguaacugugucgaauacucccuguauggcgugucugggcguggaguuuuucagaauugcacagccgugggcguccgccagcaaagauucguguacgacgcuuaucagaaccuuguagguuacuauagcgaugacgggaacuacuacuguuugagggccugcgugucaguuccggucagugugaucuaugauaaggagaccaagacucaugcaacacuguuuggcuccguggccugugaacacaucucuagcacgaugucccaguacucacggagcacccgaaguaugcucaaacgcagagacucuacuuauggaccccugcagacaccugucggcugcguucuugggcugguaaauuccagcuuguucguggaggauuguaagcucccacugggacaaucguuaugcgcucugcccgacaccccuucaacacuaacuccauga

SEQ ID NO: 1898 - RNA, 2244 nt, Artificial Sequence
  derived and/or modified CDS sequence (opt3) from MERS-CoV__ALJ54471__S1
augauccacagcguguaccugcucauguuccuucugacccccacagaguccuaugucgacguuggcccugauucugugaagucagccugcauugaaguagacauacagcaaaccuuuuucgauaaaacguggccaagaccgaucgacgugaguaaggcugaugggauuaucuacccccagggaaggaccuauagcaacauuacaaucacuuaccaggguuuguuuccuuaucagggcgaccauggggauauguacgucuauuccgcaggacacgccaccggcacaaccccacaaaaauuauucguggcgaauuacucucaggacguuaagcaguuugcuaacgguuucgugguccggauaggggccgcagccaauucgacuggaacagugaucauuucacccagcaccagugcuacgauccgcaaaauuuacccugcauuuaugcugggcuccucuguaggcaacuucagcgaugggaagaugggacgauuuuucaaucauacucuaguucuccugccagacgguuguggcacccuucugcgugccuuuuauugcaucuuggagcccagauccgggaaccacuguccugcuggaaauucauacacaaguuucgccacuuaucauaccccagcgacagauugcagcgacggcaacuacaauaggaacgcaucucucaauuccuuuaaggaauauuucaaccugcggaauuguaccuucauguacacguauaacauaacugaggaugaaauucuggagugguuugguaucacacagaccgcccaaggggugcaccucuucucaagccgcuacgucgacuuauacggaggcaauauguuucaguucgcuacucugccgguguaugacacaauuaaauacuauaguaucaucccccacucuauuagauccauacagagcgauaggaaggccugggcagcuuuuuacguguauaaacuucagccuuugaccuuccugcuagacuuuucggucgauggcuacauccggcgcgccauugacugcggguucaacgaucucucucaacugcauuguuccuaugagucauuugacguugaaaguggaguguacagcguauccucuuucgaggcgaagccaagcgguucaguggucgaacaggccgagggcguggagugcgauuuuaguccccuucuguccgggacgccuccacagguuuacaacuucaaacgauugguguuuaccaauuguaacuauaaucucacaaagcuguuaagccuguucucugucaacgacuucacuugcucacaaaucagucccgcagcuauagccagcaauuguuacuccucucucauucuugauuauuuuucguacccgcugagcaugaaguccgacuugucagugaguucugcuggaccuaucagccaguucaacuauaaacaguccuuuucaaaucccacuugccuaauccuggccacaguaccacacaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuucgggauaaccgugcaauacggaacugacaccaacagcguaugcccaaagcuagaauuugcgaaugauacaaaaaucgcaucgcagcucgguaacugugucgaguauucccuguacggcgugucugggcguggaguuuuccagaauugcaccgccgugggcguccgccagcaaagauuuguguaugacgcuuaccagaaccuuguagguuauuacagcgaugacgggaacuacuauuguuugagggccugcgugucaguuccggucagugugauuuacgauaaggagacuaagacacaugcaacgcuguucggcuccguggccugugaacacaucucuagcaccaugucccaguauucacggagcacucgaaguaugcucaaacgcagagacucuacauacggaccccugcagaccccugucggcugcguucuugggcugguaaauuccagcuuguuuguggaggauuguaagcucccacugggacaaucguuaugcgcucugcccgacacaccuucaacucuaaccccauga

SEQ ID NO: 1899 - RNA, 2244 nt, Artificial Sequence
  derived and/or modified CDS sequence (opt3) from MERS-CoV__ALJ54472__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccuucagcaacgcuucguguacgacgcuuaucagaacuugguagguuacuauagcgaugacgggaacuacuacugucugagagccugcgugucaguuccggucagugugauuuaugauaaggagacuaagacacaugcaacgcucuuuggcuccguggccugugaacacaucucuagcaccaugucccaguacucaaggagcacucggaguaugcugaaacgacgcgacucuacauauggaccccuucagaccccugucggcugcguucugggguugguaaauuccagccucuucguggaggauuguaagcugccauuaggacaaucgcugugcgcucuacccgacacaccuucaacucucgccccauga

SEQ ID NO: 1900 - RNA, 2244 nt, Artificial Sequence
  derived and/or modified CDS sequence (opt3) from MERS-CoV__ALJ54474__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccaagcacagauugcucugacggcaacuauaauaggaacgcgucccucaauucauucaaggaauacuucaaccugcggaauuguaccuuuauguauacguacaacauaacugaggaugaaauucuggagugguucgguaucacacagaccgcacaaggggugcaccucuuuagcagucgcuaugucgacuuauacggaggcaauauguuccaguuugccacucugccgguguacgacacaauuaaauauuacucuaucaucccccacuccauuagaagcauacagucggauaggaaggcuugggccgcauucuauguguacaaacuucagccuuugaccuuucugcuagacuucucugucgauggcuauauccggcgcgcuauugacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggacgccuccacagguuuacaacuuuaaacgauugguguucaccaauuguaacuacaaucucacaaagcuguuaucucuguucucagucaacgacuuuacuugcagucaaaucagccccgccgcaauagcuuccaauuguuauucuucgcucauucuugauuacuucagcuauccgcuguccaugaagucagacuugagugugucuagcgccggaccuaucucccaguuuaacuacaaacagucauucagcaauccaaccugccuaauccuggcuacaguaccccacaaccucacuaccauuacaaagccucugaaauauucuuacaucaauaagugcuccagacuucugagugaugacaggaccgaaguuccccaguuggugaacgccaaucaauauagcccaugugucucuauugugcccuccacugucugggaggacggcgauuacuaccggaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcguggaguuuuucagaauugcaccgcagugggcguccgccagcaaagauucguguacgacgccuaucagaaccuuguagguuacuauucagaugacgggaacuacuacuguuugagggcuugcgugaguguuccggucuccgugauuuaugauaaggagacuaagacacaugccacgcuguuuggcucuguggcaugugaacacaucagcuccaccaugucacaguacagccggaguacucgaucuaugcucaaacgcagagacuccacauauggaccccugcagaccccugucggcugcguucuugggcuggugaauagcucguuguucguggaggauuguaagcucccacugggacaaucauuaugcgcccugcccgacacaccuucuacucuaaccccauga

SEQ ID NO: 1901 - RNA, 2244 nt, Artificial Sequence
  derived and/or modified CDS sequence (opt3) from MERS-CoV__ALJ54483__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucuuucaguucaacuacaaacagagcuuuuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggcgauuacuaccggaaacagcucucuccucuggaaggugggggcugguuaguggccuccggaucaacgguugcuaugacagagcagcugcagaugggcuucgggauaaccgugcaauauggaacugacaccaacaguguaugcccaaagcuagaauuugcgaaugauacaaaaaucgcaagccagcucgguaacugugucgaguacucgcuguauggcguguccgggcguggaguuuuccagaauugcaccgccgugggcguccgccagcaaagauuuguguacgacgcuuaucagaaccuuguagguuacuauucugaugacgggaacuacuacuguuugagggccugcgugagcguuccggucucagugauuuaugauaaggagacuaagacacaugcaacgcuguucggcaguguggccugugaacacaucuccucuaccaugagccaguacucccggucaacucgaagcaugcucaaacgcagagacaguacauauggaccccugcagaccccugucggcugcguucuugggcugguaaauucuuccuuguuuguggaggauuguaagcucccacugggacaaaguuuaugcgcucugcccgacacaccuucgacucuaaccccauga

SEQ ID NO: 1902 - RNA, 2244 nt, Artificial Sequence
  derived and/or modified CDS sequence (opt3) from MERS-CoV__ALJ54486__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauagguacgcaucucucaacuccuucaaggaauauuucaaucugcggaacuguaccuuuauguacacguauaauauaacugaggaugaaauucuggagugguucgguaucacacagaccgcccaaggggugcaccucuuuucaagccgcuacgucgacuuauacggaggcaacauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaaugaucucucucaacugcauuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaacuguaauuauaaccucacaaagcuguuaagccuguucucugucaaugacuuuacuugcucacaaaucagucccgcagcuauagccagcaacuguuacuccucucucauucuugauuauuucucguacccgcugagcaugaaguccgacuugucagugaguucugcuggaccuaucagccaguuuaauuauaaacaguccuucucaaacccaaccugccuaauccuggccacaguaccccacaaucucacuaccauuacaaagccucugaaauacagcuauaucaacaagugcucuagacuucuguccgaugacaggaccgaaguuccccaguuggugaaugcaaaccaauacaguccaugugucagcauugugcccucuacugucugggaggacggcgauuacuaucggaaacagcucuccccucuggaaggugggggcugguuagugguuucaggaaguacgguggccaugacagagcagcugcagaugggcuuugggauaaccguacaauacggaacugacaccaauagcgucugcccaaagcuagaguucgcuaacgauacaaaaaucgcgucgcagcucgguaauuguguggaauauucccuguacggcguuucugggcguggaguguuucagaacugcaccgcagucggcgugcgccagcaaagauucguauaugacgccuaccagaaucuuguggguuauuacagcgaugacgggaacuacuauuguuugagggcuugcguuucagucccggugagugugauuuacgauaaggagacuaagacacaugccacgcuguuuggcuccgucgcaugugaacacaucucuagcaccaugucccaguauucacggagcacucgaaguaugcucaaacgcagagacucuacauacggaccccugcagaccccuguuggcugcgugcuugggcuggugaacuccagcuuguucguagaggauuguaagcucccacugggacaaucguuaugcgcccugcccgacacaccuucaacucuaaccccauga

SEQ ID NO: 1903 - RNA, 2244 nt, Artificial Sequence
  derived and/or modified CDS sequence (opt3) from MERS-CoV__ALJ54488__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauauaugucuacuccgcaggacacgccaccggcacaaccccacaaaaauuauuuguggcgaauuauucucaggacguuaagcaguucgcuaacgguuuugugguccggaucggggccgcagccaauucgacuggaacagugauuaucucacccagcaccagugcuacgauucgcaaaaucuacccugcauucaugcugggcuccucuguaggcaacuuuagcgaugggaagaugggacgauucuuuaaucauacucuaguucuccugccagacgguuguggcacccuucugcgugccuucuacugcauauuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauuacugaggaugaaauccuggagugguucgguauuacacagaccgcccaaggggugcaccucuuuucaagccgcuaugucgacuuauacggaggcaauauguuccaguuugcuacucugccgguguacgacacaaucaaauauuacaguaucauuccccacucuauaagauccauccagagcgauaggaaggccugggcagcuuucuauguguacaaacuucagccuuugaccuuucugcuagacuucucggucgauggcuauauucggcgcgccaucgacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaauaagucccgcagcuauugccagcaauuguuauuccucucucauccuugauuacuucucguauccgcugagcaugaaguccgacuugucagugaguucugcuggaccuaucagccaguuuaacuacaaacaguccuucucaaauccaaccugccuaauucuggccacaguaccccacaaccucacuaccaucacaaagccucugaaauauagcuacauuaauaagugcucuagacuucuguccgaugacaggaccgaaguuccccaguuggugaacgcaaaucaauauaguccaugugucagcauagugcccucuacugucugggaggacggcgauuacuaccggaaacagcucuccccucuggaaggugggggcugguuaguggccucaggaaguacgguugcuaugacagagcagcugcagaugggcuuugggaucaccgugcaauauggaacugacaccaacagcguaugcccaaagcuagaguucgcgaaugauacaaaaauugcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugaucuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1904 - RNA, 2244 nt, Artificial Sequence
  derived and/or modified CDS sequence (opt3) from MERS-CoV__ALJ54490__S1
augauccacagcguguuccugcucauguuucuucugacccccacagaguccuacgucgacguuggcccugauucugugaagucagccugcauugcuguagacauacagcaaacuuucuuugauaaaacguggccaagaccgaucgacgugaguaaggcagaugggauuaucuauccccagggaaggaccuacagcaacauuacaaucacuuaucaggguuuguucccuuaccagggcgaccauggggauauguaugucuacuccgccggacacgcgaccggcacaaccccacaaaaauuauuuguggcuaauuauucucaggacguuaagcaguucgccaacgguuuugugguccggauaggggcagccgcuaauucgacuggaacagugaucauuucacccagcaccagugcaacgauccgcaaaauuuacccugccuucaugcugggcuccucuguaggcaacuuuagcgaugggaagaugggacgauucuuuaaucauacucuaguucuccugccagacgguuguggcacccuucugcgugcuuucuacugcaucuuggaacccagauccgggaaccacuguccugccggaaauucauauacaaguuuugcgacuuaccauaccccagcaacagauugcagcgacggcaacuauaauaggaacgccucucucaauuccuucaaggaguacuucaaccugcggaauuguaccuuuauguauacguacaacauaacugaagaugagauucuggaaugguucgguaucacacagaccgcucaaggggugcaccucuuuucaagccgcuaugucgacuuauacggaggcaauauguuccaguuugccacucugccgguguacgacacaauuaaauauuacaguaucaucccccacucuauuagauccauacagagcgauaggaaggcaugggcugccuucuauguguacaaacuucagccuuugaccuuucugcuagacuucucggucgauggcuauauccggcgcgcgauugacugcggguuuaacgaucucucucaacugcauuguuccuacgagucauucgacguugagaguggaguguauagcguauccucuuuugaagccaagccaagcgguucaguggucgagcaggcagaaggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcugccauagcuagcaauuguuauuccucucucauucuugauuacuucucguauccgcugagcaugaaguccgacuugucagugaguucugccggaccuaucagccaguuuaacuacaaacaguccuucucaaauccaaccugccuaauccuggcaacaguaccccacaaccucacuaccauuacaaagccucugaaauauagcuacaucaauaagugcucuagacuucuguccgauggcaggaccgagguuccccaguuggugaacgccaaucaauauaguccaugugucagcauugugcccucuacugucugggaagacggugacuacuaccggaaacagcucuccccucuggaagggggcggaugguuaguggcuucaggcaguacgguugcgaugacagagcagcugcagaugggguuuggaauaaccgugcaauaugguacugauaccaacagcguaugcccaaagcuagaguucgcaaaugacacaaaaaucgccucgcagcucggcaacugugucgaauacucccuguauggggugucuggacguggcguuuuucagaauugcaccgcuguggguguccgccagcaaagauucguguacgaugccuaucagaaccuuguaggguacuauagcgacgauggcaacuacuacuguuugagggcaugcgugucaguuccggucagugugauuuaugacaaggagacuaagacacaugccacgcuguuuggauccguggcuugugagcacaucucuagcaccaugucccaguacucacggagcacucgaaguaugcucaaacgcagagauucuacauauggcccccugcagaccccugucgggugcguucuuggacugguaaauuccagcuuguucguggaagacuguaagcucccacugggucaaucguuaugcgcccugcccgauacaccuucaacucuaaaaccauga

SEQ ID NO: 1905 - RNA, 2244 nt, Artificial Sequence
  derived and/or modified CDS sequence (opt3) from MERS-CoV__ALJ54495__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuagugguuucaggaaguacgguggccaugacagagcagcugcagaugggcuuugggauaaccguacaauauggaacugacaccaacagcgucugcccaaagcuagaguucgcuaaugauacaaaaaucgcgucgcagcucgguaacuguguggaauacucccuguauggcguuucugggcguggaguguuucagaauugcaccgcagucggcgugcgccagcaaagauucguauacgacgccuaucagaaccuuguggguuacuauagcgaugacgggaacuacuacuguuugagggcuugcguuucagucccggugagugugauuuaugauaaggagacuaagacacaugccacgcuguuuggcuccgucgcaugugaacacaucucuagcaccaugucccaguacucacggagcacucgaaguaugcucaaacgcagagacucuacauauggaccccugcagaccccuguuggcugcgugcuugggcugguaaauuccagcuuguucguggaggauuguaagcucccacugggacaaucguuaugcgcccugcccgacacaccuucaacucuaaccccauga

SEQ ID NO: 1906 - RNA, 2244 nt, Artificial Sequence
  derived and/or modified CDS sequence (opt3) from MERS-CoV__ALJ54496__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucccuccgaugacaggaccgaaguuccacagcuggugaacgcaaaucaauauagucccugugucagcauugugccuucuacugucugggaggacggcgauuacuaccggaaacaguuguccccacucgaaggugggggcuggcugguggccucaggaaguacgguugcuaugacagagcaguuacagaugggcuuugggauaaccgugcaauauggaacugacaccaacagcguaugcccgaagcuggaguucgcgaaugauacaaaaaucgcaucgcagcuagguaacugugucgaauacucccucuauggcgugucugggcguggaguuuuucagaauugcaccgccgugggcguccgccagcaaagauucguguacgacgcuuaucagaaccugguagguuacuauagcgaugacgggaacuacuacugucuuagggccugcgugucaguucccgucagugugauuuaugauaaggagacuaagacacaugcaacguuguuuggcuccguggccugugaacacaucucuagcaccaugucccaguacucacggagcacucgaaguaugcugaaacgcagagacucuacauauggaccucuccagaccccagucggcugcguucuggggcuuguaaauuccagccuguucguggaggauuguaaguugccccucggacaaucgcugugcgcuuuaccugacacaccaucaacucugacccccuga

SEQ ID NO: 1907 - RNA, 2244 nt, Artificial Sequence
  derived and/or modified CDS sequence (opt3) from MERS-CoV__ALJ54500__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucagucuucuguuguccgggacgcccccucagguuuacaacuuuaaacgacucguguucaccaauuguaacuacaaucugacaaaguuacugagccucuucucugucaacgacuuuacuugcucacaaaucaguccagcagcuauagccagcaauuguuauuccucucuuauucuggauuacuucucguaucccuugagcaugaaguccgaccuaucagugaguucugcuggaccgaucagccaguuuaacuacaaacaguccuucucaaauccuaccugccugauccucgccacaguaccccacaaccugacuaccauuacaaagccacuuaaauauagcuacaucaauaagugcucuagacuguuguccgaugacaggaccgaaguuccucagcucgugaacgcaaaucaauauagucccugugucagcauugugccaucuacugucugggaggacggcgauuacuaccggaaacagcugucccccuuagaaggugggggcuggcugguggccucaggaaguacgguugcuaugacagagcagcuacagaugggcuuugggauaaccgugcaauauggaacugacaccaacagcguaugcccuaagcucgaguucgcgaaugauacaaaaaucgcaucgcagcuggguaacugugucgaauacucccuuuauggcgugucugggcguggaguuuuucagaauugcaccgccgugggcguccgccagcaaagauucguguacgacgcuuaucagaacuugguagguuacuauagcgaugacgggaacuacuacugucugagggccugcgugucaguuccagucagugugauuuaugauaaggagacuaagacacaugcaacgcucuuuggcuccguggccugugaacacaucucuagcaccaugucccaguacucacggagcacucgaaguaugcugaaacgcagagacucuacauauggaccgcuucagacccccgucggcugcguucugggguugguaaauuccagccucuucguggaggauuguaagcugccuuuaggacaaucgcugugcgcucuaccagacacacccucaacucucaccccuuga

SEQ ID NO: 1908 - RNA, 2244 nt, Artificial Sequence
  derived and/or modified CDS sequence (opt3) from MERS-CoV__ALJ54501__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacucucugggaggacggcgauuacuaccggaaacagcuguccccuuuagaaggugggggcuggcuggucgccucaggaaguacgguggcuaugacagagcagcuacagaugggcuuugggauaaccguucaauauggaacugacaccaacagcgugugcccaaagcucgaguucgcgaaugauacaaaaaucgcaucgcagcuggguaacuguguagaauacucccuuuauggcgucucugggcguggaguguuucagaauugcaccgccguuggcgugcgccagcaaagauucgucuacgacgcuuaucagaacuugguggguuacuauagcgaugacgggaacuacuacugucugagggccugcguaucagugccgguuagugucauuuaugauaaggagacuaagacacaugcaacgcucuuuggcuccguggccugugaacacaucucuagcaccaugucccaguacucacggagcacucgaaguaugcugaaacgcagagacucuacauauggaccccuucagaccccugugggcugcguccugggguugguuaauuccagccucuucguggaggauuguaagcugccauuaggacaaucgcugugcgcucuacccgacacaccuucaacucucaccccauga

SEQ ID NO: 1909 - RNA, 2244 nt, Artificial Sequence; identical to SEQ ID NO: 1852
  derived and/or modified CDS sequence (opt3) from MERS-CoV__ALJ54502__S1

SEQ ID NO: 1910 - RNA, 2244 nt, Artificial Sequence
  derived and/or modified CDS sequence (opt3) from MERS-CoV__ALJ54512__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggcucaccucuuuucaagccgcuauguggacuuauacggaggcaauauguuccaguuugccacucugccggucuacgacacaauuaaauauuacaguaucaucccccacucuauuagauccauacagagcgauaggaaggcaugggcugccuucuauguguacaaacuucagccuuugaccuuucugcuagacuucucgguggauggcuauauccggcgcgcgauugacugcggguuuaacgaucucucucaacugcauuguuccuacgagucauucgacgucgaaaguggaguuuauagcguguccucuuuugaggccaagccaagcgguucaguaguggaacaggcagagggcgucgagugcgauuucaguccccuucuguccgggacgccuccacagguguacaacuuuaaacgauugguuuucaccaauuguaacuacaaucucacaaagcuguuaagccuguucucugugaacgacuuuacuugcucacaaaucagucccgcugccauagcuagcaauuguuauuccucucucauucuugauuacuucucguauccgcugagcaugaaguccgacuugucagucaguucugccggaccuaucagccaguuuaacuacaaacaguccuucucaaauccaaccugccuaauccuggcaacagugccccacaaccucacuaccauuacaaagccucugaaauauagcuacaucaauaagugcucuagacuucuguccgaugacaggaccgaaguaccccaguugguuaacgccaaucaauauaguccaugugugagcauuguccccucuacugugugggaggacggcgauuacuaccggaaacagcucuccccucuggaaggugggggcugguuagucgcuucaggaaguacgguggcgaugacagagcagcugcagaugggcuuugggauaaccguucaauauggaacugacaccaacagcgugugcccaaagcuagaguucgcaaaugauacaaaaaucgccucgcagcucgguaacuguguagaauacucccuguauggcgucucugggcguggaguguuucagaauugcaccgcuguuggcgugcgccagcaaagauucgucuacgacgccuaucagaaccuuguggguuacuauagcgaugacgggaacuacuacuguuugagggcaugcguaucagugccgguuagugucauuuaugauaaggagacuaagacacaugccacgcuguuuggcuccguggcuugugaacacaucucuagcaccaugucccaguacucacggagcacucgaaguaugcucaaacgcagagacucuacauauggaccccugcagaccccugugggcugcguccuugggcugguuaauuccagcuuguucguggaggauuguaagcucccacugggacaaucguuaugcgcccugcccgacacaccuucaacucuaaccccauga

SEQ ID NO: 1911 - RNA, 2244 nt, Artificial Sequence
  derived and/or modified CDS sequence (opt3) from MERS-CoV__ALJ54517__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcaacuacuaccggaaacagcucuccccucuggaaggugggggcugguuaguggccucaggaaguacgguugcuaugacagagcagcugcagaugggcuuugggauaaccgugcaauauggaacugauaccaauagcguaugcccaaagcuagaguucgcgaacgacacaaaaaucgcaucgcagcucgguaauugugucgaauacucccuguauggcgugucugggcguggaguuuuucagaacugcaccgccgugggcguccgccagcaaagauucguguacgaugcuuaucagaaccuuguagguuacuauagcgacgaugggaauuacuacuguuugagggccugcgugucaguuccggucagugugauuuaugacaaggagacuaagacacaugcaacgcuguuuggcuccguggccugugaacacaucucuagcaccaugucccaguacucacggagcacucgaaguaugcucaaacgcagagauucuacauauggaccccugcagaccccugucggcugcguucuugggcuggugaacuccagcuuguucguggaggacuguaagcucccacugggacaaucguuaugcgcucugcccgauacaccuucaacucuaaccccauga

SEQ ID NO: 1912 - RNA, 2244 nt, Artificial Sequence; identical to SEQ ID NO: 1906
  derived and/or modified CDS sequence (opt3) from MERS-CoV__ALJ54518__S1

SEQ ID NO: 1913 - RNA, 2244 nt, Artificial Sequence
  derived and/or modified CDS sequence (opt3) from MERS-CoV__ALW82691__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuuagguccgaugaccggaccgaaguuccccagcuggugaacgcaaaucaauauaguccaugugucagcauugugcccucuacugucugggaggacggcgauuacuaccguaaacaguuguccccucucgaaggugggggcuggcugguggccucaggaaguacgguugcuaugacagagcaguuacagaugggcuuugggauaaccgugcaauauggaacugacaccaacagcguaugcccaaagcuggaguucgcgaaugauacaaaaaucgcaucgcagcuagguaacugugucgaauacucccucuauggcgugucugggcgcggaguuuuucagaauugcaccgccgugggcgucagacagcaaagguucguguacgacgcuuaucagaaccugguagguuacuauagcgaugacgggaacuacuacugucuucgggccugcgugucaguuccggucagugugauuuaugauaaggagacuaagacacaugcaacguuguuuggcuccguggccugugaacacaucucuagcaccaugucccaguacucacgaagcacucgcaguaugcugaaaagaagggacucuacauauggaccccuccagaccccugucggcugcguucuggggcuuguaaauuccagccuguucguggaggauuguaaguugccacucggacaaucgcugugcgcuuuacccgacacaccuucaacucugaccccauga

SEQ ID NO: 1914 - RNA, 2244 nt, Artificial Sequence
  derived and/or modified CDS sequence (opt3) from MERS-CoV__ALW82742__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccagaaaauuuacccugcauucaugcugggcuccucuguaggcaacuuuagcgaugggaagaugggacgcuucuuuaaucauacucuaguucuccugccagacgguuguggcacccuucugcgagccuucuacugcaucuuggagccccguuccgggaaccacuguccugcuggaaauucauauacaaguuuugccacuuaccauaccccagcgacagauugcagcgacggcaacuauaauagaaacgcaucucucaauuccuucaaggaauacuucaaccugaggaauuguaccuuuauguauacguacaacauaacugaggaugaaauucuggagugguucgguaucacacaaaccgcccagggggugcaccucuuuucaagccgguaugucgacuuauacggaggcaauauguuccaguuugcuacucugccgguguacgacacaauuaaauauuacaguaucaucccccacucuauucgcuccauacagagcgauagaaaggccugggcagcuuucuauguguacaaacuucaaccuuugaccuuucugcuagacuucucggucgauggcuauaucaggcgggccauugacugcggguuuaacgaucucucucagcugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacaaguuuacaacuuuaaacgcuugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucucgacuucuguccgaugacagaaccgaaguuccccaauuggugaacgcaaaucaguauaguccaugugucagcauugugcccucuacugucugggaggacggcgauuacuacaggaaacagcucuccccucuggaaggugggggcugguuaguggccucaggaaguacgguugcuaugacagagcagcugcaaaugggcuuugggauaaccgugcaguauggaacugacaccaacagcguaugcccaaagcuagaguucgcgaaugauacaaaaaucgcaucgcagcucgguaacugugucgaauacucccuguauggcgugucugggcggggaguuuuucagaauugcaccgccgugggcguccgucaacagcgcuucguguacgacgcuuaucagaaccuuguagguuacuauagcgaugacgggaacuacuacuguuugagagccugcgugucaguuccggucagugugauuuaugauaaggagacuaagacacaugcaacgcuguuuggcuccguggccugugaacacaucucuagcaccaugucccaguacucaaggagcacucggaguaugcucaaacgacgcgacucuacauauggaccccugcaaaccccugucggcugcguucuugggcugguaaauuccagcuuguucguggaggauuguaagcucccacugggacagucguuaugcgcucugcccgacacaccuucaacucuaaccccauga

SEQ ID NO: 1915 - RNA, 2244 nt, Artificial Sequence; identical to SEQ ID NO: 1900
  derived and/or modified CDS sequence (opt3) from MERS-CoV__ALW82753__S1

SEQ ID NO: 1916 - RNA, 2244 nt, Artificial Sequence
  derived and/or modified CDS sequence (opt3) from MERS-CoV__ALX27228__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucuggaaagacggcgauuacuaccggaagcagcucuccccucuggagggugggggcugguuaguggccucaggaaguacgguugcuaugacagaacagcugcagaugggcuuugggauaaccgugcaauauggaacugacaccaacagcguaugcccaaaacuagaguucgcgaaugauacaaagaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaaaacacaugcaacgcuguuuggcuccguggccugugagcacaucucuagcaccaugucccaguacucacggagcacucgaaguaugcucaagcgcagagacucuacauauggaccccugcagaccccugucuccugcguucuuggccuggugaauagcucguuguucguggaagauuguaaacucccacuggggcaaucauuaugcgcucugcccgacacaccuucuacucuaaccccauga

SEQ ID NO: 1917 - RNA, 2244 nt, Artificial Sequence; identical to SEQ ID NO: 1858
  derived and/or modified CDS sequence (opt3) from MERS-CoV__ALX27232__S1

SEQ ID NO: 1918 - RNA, 2244 nt, Artificial Sequence
  derived and/or modified CDS sequence (opt3) from MERS-CoV__AMQ48993__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguauaguugcuaugacggagcagcugcagaugggcuuugggaucacagugcaauauggaaccgacacuaacagcguaugcccaaagcuagaguucgcgaaugauaccaaaauugcaucgcagcucgguaacugugucgaauacucccuguauggcgugucugggcguggaguuuuucagaauugcacagccgugggcguccgccagcaaagauucguguacgacgcuuaucagaaccuuguagguuacuauagcgaugacgggaacuacuacuguuugagggccugcgugucaguuccggucagugugaucuaugauaaggagaccaagacucaugcaacacuguuuggcuccguggccugugaacacaucucuagcacgaugucccaguacucacggagcacccgaaguaugcucaaacgcagagacucuacuuauggaccccugcagacaccugucggcugcguucuugggcugguaaauuccagcuuguucguggaggauuguaagcucccacugggacaaucguuaugcgcucugcccgacaccccuucaacacuaacuccauga

SEQ ID NO: 1919 - RNA, 2244 nt, Artificial Sequence
  derived and/or modified CDS sequence (opt3) from MERS-CoV__AMW90844__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccuuccaauauggaacugacaccaacagcgugugcccaaagcuagaauuugcgaaugauacaaaaaucgcaucgcagcucgguaacuguguagaguacucccuguauggcgucucugggcguggaguguuccagaauugcaccgccguuggcgugcgccagcaaagauuugucuacgacgcuuaucagaaccuuguggguuacuauagcgaugacgggaacuacuacuguuugagggccugcguaucagugccgguuagugucauuuaugauaaggagacuaagacacaugcaacgcuguucggcuccguggccugugaacacaucucuagcaccaugucccaguacucacggagcacucgaaguaugcucaaacgcagagacucuacauauggaccccugcagaccccugugggcugcguccuugggcugguuaauuccagcuuguuuguggaggauuguaagcucccacugggacaaucguuaugcgcucugcccgacacaccuucaacucuaaccccauga

SEQ ID NO: 1920 - RNA, 2244 nt, Artificial Sequence; identical to SEQ ID NO: 1872
  derived and/or modified CDS sequence (opt3) from MERS-CoV__AMW90852__S1

SEQ ID NO: 1921 - RNA, 2244 nt, Artificial Sequence
  derived and/or modified CDS sequence (opt3) from MERS-CoV__AMW90853__S1
augauccacagcguguuccugcucauguuucuucugacccccacagaguccuacgucgacguuggcucugauucagugaagagugccugcauugaaguagacauacagcaaacuuucuuugauaaaacguggccuagaccaaucgacgugagcaaggcugaugggauuaucuauccgcagggaaggaccuacuccaacauuacaaucacuuaucaggguuuguuccccuaccagggcgaccauggggauauguaugucuacucugcaggauaugccaccggcacaaccccucaaaaauuauuuguggcgaauuacucgcaggacguuaagcaguucgcuaacgguuuugugguccggauaggggccgcagccaauucaacuggaacagugaucauuagcccaaguaccuccgcuacgauccgcaaaauuuaccccgcauucaugcugggcucuagcguaggcaacuuuuccgaugggaagaugggacgauucuuuaaucacacucuaguucuccugccugacgguuguggcacccuucugcgugccuucuauugcaucuuggagccaagaucagggaaccauugucccgcuggaaauaguuacacuagcuuugccacauaucacaccccugcgacagauugcucugacggcaacuacaauaggaacgcaucccucaauucauucaaggaauauuucaaccugcggaauuguaccuuuauguacacguauaacauaacugaggaugaaauucuggagugguucgguaucacacagaccgcccaaggggugcaucucuuuagcagucgcuacgucgacuuauacggaggcaauauguuccaguuugcuacucugccaguguaugacacaauuaaauacuauucuaucaucccgcacuccauuagaagcauacagucggauaggaaggccugggcagcuuucuacguguauaaacuucagcccuugaccuuucugcuagacuucucugucgauggcuacauccggcgcgccauugacugcggguuuaacgaucucucccaacugcacuguucauaugagaguuucgacguugaaagcggaguguacuccguaucuagcuuugaggcgaagccuucagguaguguggucgaacaggccgagggcguggagugcgauuucuccccacuucugagcgggacgcccccucagguuuacaacuuuaaacgauugguguucaccaauuguaacuauaauuucacaaagcuccugucuuuauuuucagucaacgacuucacuugcagucaaaucagcccagcagcuauagccuccaauuguuacucuucgcugauucucgauuauuuuagcuacccccuuuccaugaagucagaccugagugugucuagcgcuggaccgaucucccaguucaacuauaaacagucauuuagcaauccuaccugcuugauccuagccacaguaccccauaaccugacuaccauuacaaagccacucaaauacucuuauaucaauaagugcuccagacugcuuagugaugacaggaccgaaguuccucagcuggugaacgcaaaucaauacagccccugugucucuauugugccauccacugucugggaggacggcgauuacuaucggaaacaguugucaccccucgaaggugggggcuggcugguggccaguggaagcacgguugcuaugacagagcaguuacagaugggcuucgggauaaccgugcaauacggaacugacaccaacucgguaugcccuaagcuggaauuugcgaaugauacaaaaaucgcaucccagcuagguaacugugucgaguauucucucuacggcgugagcgggcguggaguuuuccagaauugcaccgccgugggcguccgccagcaaagauuuguguaugacgcuuaccagaaccugguagguuauuacucagaugacgggaacuacuauugucuuagggccugcgugaguguuccagucuccgugauuuacgauaaggagacuaagacacacgcaacguuguucggcucuguggccugugaacauaucagcuccaccaugucacaguauagccggaguacucgaucuaugcugaaacgcagagacuccacauacggaccgcuccagacccccgucggcugcguucuggggcuugugaauagcucgcuguuuguggaggauuguaaguugccucucggacaaucacugugcgcuuuaccagacacacccucuacucugaccccuuga

SEQ ID NO: 1922 - RNA, 2244 nt, Artificial Sequence
  derived and/or modified CDS sequence (opt3) from MERS-CoV__ANC28656__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgauggcaggaccgaaguuccccaguuggugaacgcaaaucaauauaguccaugugucagcauugugcccucuacugucugggaggacggugacuacuaccggaaacagcucuccccucuggaagggggcggaugguuaguggccucaggcaguacgguugcuaugacagagcagcugcagaugggguuuggaauaaccgugcaauaugguacugauaccaacagcguaugcccaaagcuagaguucgcgaaugacacaaaaaucgcaucgcagcucggcaacugugucgaauacucccuguauggggugucuggacguggcguuuuucagaauugcaccgccguggguguccgccagcaaagauucguguacgaugcuuaucagaaccuuguaggguacuauagcgacgauggcaacuacuacuguuugagggccugcgugucaguuccggucagugugauuuaugacaaggagacuaagacacaugcaacgcuguuuggauccguggccugugaacacaucucuagcaccaugucccaguacucacggagcacucgaaguaugcucaaacgcagagauucuacauauggcccccugcagaccccugucgggugcguucuuggacugguaaauuccagcuuguucguggaggacuguaagcucccacugggucaaucguuaugcgcucugcccgauacaccuucaacucuaaccccauga

SEQ ID NO: 1923 - RNA, 2244 nt, Artificial Sequence
  derived and/or modified CDS sequence (opt3) from MERS-CoV__ANC28678__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuugcuccauacagagcgauagaaaggccugggcagcuuucuauguguacaaacuucagccuuugaccuuucugcuagacuucucggucgauggcuauaucaggcgggccauugacuguggguuuaacgaucucucucaacugcauugcuccuacgagucauucgacguugaaaguggaguguauagcguauccucuuuugaggcgaagccaagcgguucaguggucgaacaggccgagggcguggagugugauuucaguccccuucuguccgggacgccuccacagguuuacaacuuuaaacgcuugguguucaccaauugcaacuacaaucucacaaagcuguuaagccuguucucugucaacgacuuuacuuguucacaaaucagucccgcagcuauagccagcaauugcuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaaguguucucgacuucuguccgauggcagaaccgaaguuccccaguuggugaacgcaaaucaauauaguccaugcgucagcauugugcccucuacugucugggaggacggugacuacuacaggaaacagcucuccccucuggaagggggcggaugguuaguggccucaggcaguacgguugcuaugacagagcagcugcagaugggguuuggaauaaccgugcaauaugguacugauaccaacagcguauguccaaagcuagaguucgcgaaugacacaaaaaucgcaucgcagcucggcaacugcgucgaauacucccuguauggggugucuggacggggcguuuuucagaauuguaccgccguggguguccgucagcaacgcuucguguacgaugcuuaucagaaccuuguaggguacuauagcgacgauggcaacuacuacugcuugagagccugugugucaguuccggucagugugauuuaugacaaggagacuaagacacaugcaacgcuguuuggauccguggccugcgaacacaucucuagcaccaugucccaguacucaaggagcacucggaguaugcucaaacgacgcgauucuacauauggcccccugcagaccccugucggguguguucuuggacugguaaauuccagcuuguucguggaggacugcaagcucccacugggucaaucguuaugugcucugcccgauacaccuucaacucuaaccccauga

SEQ ID NO: 1924 - RNA, 2244 nt, Artificial Sequence
  derived and/or modified CDS sequence (opt3) from MERS-CoV__AHL18090__S1
augauccacagcguguuccugcucauguuucuucugacccccacagaguccuacgucgacguuggcuuggauucugccaagucagcuugcauugaaguggacauacagcagacuuucuuugauaaaacguggccuagaccaaucgacguaaguaaggcagaugggauuaucuauccgcagggaaggaccuacagcaacauuacaaucacuuaucaggguuuauuccccuaccagggcgaccauggggauauguauguguacuccgccggacacgcgaccggcacaaccccucaaaaacuguuugucgcuaauuauucucaggacgugaagcaguucgccaacgguuuuguugugcggauaggggcagccgcuaauucgacuggaacagucaucauuucaccaagcaccagugcaacgauccgcaaaauuuaccccgccuucaugcuaggcuccucugugggcaacuuuagcgaugggaagaugggacgauucuuuaaucauacucucguacugcuuccugacgguuguggcacccuguugcgugcuuucuacugcauccucgagccaagauccgggaacuauugucccgccggaaauucauacacaaguuuugcgacuuaucacaccccugcaacagauugcagcgacggcaacuacaauaggaacgccucucucaauuccuucaaggaauauuucaaccugcggaauuguaccuuuauguacacguauaacauaacugaggaugaaauucucgagugguucgguaucacacagaccgcucaagggguucauuuauuuucaagccgcuacguggaccuguacggaggcaauauguuccaguuugccacucuuccagucuaugacacaauuaaauacuauaguaucaucccgcacucuauuagauccauacagagcgauaggaaggcaugggcugccuucuacguguauaaauugcagccccugaccuuucuacucgacuucucgguggauggcuacauccggcgcgcgauugacugcggguuuaacgaucugucucaacuucacuguuccuaugagucauucgacgucgaaaguggaguuuacagcguguccucuuuugaggccaagccuagcgguucaguaguggaacaggcagagggcgucgagugcgauuucaguccacuguuguccgggacgcccccucagguguacaacuuuaaacgacucguuuucaccaauuguaacuauaaucugacaaaguuacugagccucuucucugugaacgacuuuacuugcucacaaaucaguccagcugccauaagcuccaauuguuacucuucgcuuauucuggauuauuucagcuaccccuuguccaugaagucagaccuaagugucucuagcgcuggaccgaucucccaguuuaacuauaaacagucauucagcaauccuaccugccugauccucgccacagugccccauaaccugacuaccauuacaaagccacuuaaauacucuuauaucaauaagugcuccagacuguugagugaugacaggaccgaaguaccucagcucguuaacgcaaaucaauacagccccugugugucuauugucccauccacugugugggaggacggcgauuacuaucggaaacagcugucacccuuagaaggugggggcuggcuggucgccaguggaagcacgguggcuaugacagagcagcuacagaugggcuuugggauaaccguucaauacggaacugacaccaacucggugugcccuaagcucgaguucgcgaaugauacaaaaaucgcaucccagcuggguaacuguguagaauauucucuuuacggcgucagcgggcguggaguguuucagaauugcaccgccguuggcgugcgccagcaaagauucgucuaugacgcuuaccagaacuugguggguuauuacucagaugacgggaacuacuauugucugagggccugcguaagugugccaguuuccgucauuuacgauaagaagacuaaaacacacgcaacgcucuuuggcucuguggccugugagcauaucagcuccaccaugucacaguauagccggaguacucgaucuacacugaagcgcagagacuccaccuacggaccgcuucagacacccgugggcugcguccugggguugguuaauagcucgcuguucguggaagauuguaaacugccuuuaggacaaucacugugcgcucuaccagacacucccucuacccucacgccuuga

SEQ ID NO: 1925 - RNA, 2244 nt, Artificial Sequence
  derived and/or modified CDS sequence (opt3) from MERS-CoV__AHX00731__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugggagugucaagugcuggcccuaucucucaguuuaacuacaaacagagcuucuccaauccaaccugccuaauccuggccacaguaccccacaaccucacuaccauuacaaagccucugaaauauucauacaucaauaagugcagcagacuucugucugaugacaggaccgaaguuccccaguuggugaacgcaaaucaauauuccccaugugucaguauugugcccagcacugucugggaggacggugauuacuaccggaaacagcucucuccucuggaagggggcggaugguuaguggccuccggcucaacgguugcuaugacagagcagcugcagaugggguuuggaauaaccgugcaauaugguacugacaccaacaguguaugcccaaagcuagaauuugcgaaugauacaaaaaucgcaagccagcucggcaacugugucgaguacucgcuguaugggguguccggacguggcguuuuucagaauugcaccgccguggguguccgccagcaaagauucguguacgacgcuuaucagaaccuuguaggguacuauucugaugacggcaacuacuacuguuugagggccugcgugagcguuccggucucagugauuuaugauaaggagacuaagacacaugcaacgcuguuuggaaguguggccugugaacacaucuccucuaccaugagccaguacucccggucaacucgaagcaugcucaaacgcagagacaguacauauggcccccugcagaccccugucgggugcguucuuggacugguaaauucuuccuuguucguggaggauuguaagcucccacugggucaaagccucugcgcucugcccgacacaccuucgacucuaaccccauga

SEQ ID NO: 1926 - RNA, 2244 nt, Artificial Sequence
  derived and/or modified CDS sequence (opt3) from MERS-CoV__AHX71946__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucacauacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaccucuuuucaagccgcuacgucgacuuauauggaggcaauauguuccaguuugcuacucugccgguguacgacacaauuaaauacuauaguaucaucccccauucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuauaacuuuaaacgauugguguucaccaauuguaacuacaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuauuaccggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuauuacuguuugagggccugcgugucaguuccggucagugugauuuacgauaaggagacuaagacacacgcaacgcuguuuggcuccguggccugugaacacaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1927 - RNA, 2244 nt, Artificial Sequence
  derived and/or modified CDS sequence (opt3) from MERS-CoV__AHY22545__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaucgauugguguucaccaacuguaauuacaaccucacaaaacuguuaagccuguucucugucaaugacuuuacuugcucacaaaucagucccgcagcuauagccagcaacuguuauuccucucucauucuugauuacuucucguauccgcugagcaugaaguccgacuugucagugaguucugcuggaccuaucagccaguuuaauuacaagcaguccuucucaaacccaaccugccuaauccuggccacaguaccccacaaucucacuaccauuacaaaaccucugaaguauagcuacaucaacaaaugcucuagacuucuguccgaugacaggaccgaaguuccccaguuggugaaugcaaaccaauauaguccaugugucagcauugugcccucuacugucugggaggacggcgauuacuaccggaagcagcucuccccucuggaaggugggggcugguuaguggccucaggaaguacgguugcuaugacagagcagcugcagaugggcuuugggauaaccgugcaauauggaacugacaccaauagcguaugcccaaaacuagaguucgcgaacgauacaaagaucgcaucgcagcucgguaauugugucgaauacucccuguauggcgugucugggcguggaguuuuucagaacugcaccgccgugggcguccgccagcaaagauucguguacgacgcuuaucagaaccuuguagguuacuauagcgaugacgggaauuacuacuguuugagggccugcgugucaguuccggucagugugauuuaugauaaagagacuaagacacaugcaacgcuguuuggcuccguggccugugaacacaucucuagcaccaugucccaguacucacggagcacucgaaguaugcucaagcgcagagacucuacauauggaccccugcagaccccugucggcugcguucuugggcuggugaacuccagcuuguucguggaggauuguaaacucccacugggacaaucguuaugcgcucugcccgacacaccuucaacucuaaccccauga

SEQ ID NO: 1928 - RNA, 2244 nt, Artificial Sequence
  derived and/or modified CDS sequence (opt3) from MERS-CoV__AHY22555__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaauuacacucuaguucuccugccagacgguuguggcacccuucugcgugccuucuauugcaucuuggagcccagauccgggaaccauuguccugcuggaaauucauacacaaguuuugccacuuaucacaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcaucguucuacguguauaaacuucagccuuugaccuuucugcuagacuucucugucgauggcuacauccggcgcgcuauugacugcggguuuaacgaucucucccaacugcacuguucauaugagaguuucgacguugaaagcggaguguacuccguaucuagcuuugaggccaagccaucagguaguguggucgaacaggcggagggcguggagugcgauuucagcccccuucuguccgggacgccuccacagguuuacaacuuuaaacgauugguguucaccaauuguaacuauaaucucacaaagcuguuaucucuguucucagucaacgacuuuacuugcagucaaaucagccccgccgcaauagcuuccaauuguuacucuucgcucauucuugauuauuucagcuacccgcuguccaugaagucagacuugagugugucuagcgccggaccuaucucccaguuuaacuauaaacagucauucagcaauccaaccugccuaauccuggcuacaguaccccauaaccucacuaccauuacaaagccucugaaauacucuuauaucaauaagugcuccagacuucugagugaugacaggaccgaaguuccccaguuggugaacagcaaucaauacucuccaugugucuccauugugcccucaacugucugggaggacggcgauuacuaucggaaacagcucaguccucuggaaggugggggcugguuaguggccagcggaucgacgguugcaaugacagagcagcugcagaugggcuuugggauaaccgugcaauacggaacugacaccaacuccguaugcccaaagcuagaguucgccaaugauacaaaaaucgcuucucagcucgguaacugugucgaauauagccuguacggcgugucagggcguggaguuuuucagaauugcaccgcggugggcguccgccagcaaagauucguguaugacgcauaccagaaccuuguagguuauuacagugaugacgggaacuacuauuguuugagggccugcguguccguuccggucucugugauuuacgauaaggagacuaagacacacgcuacgcuguuuggcagcguggccugugaacauaucuccucaaccaugagccaguauagucggucuacucgauccaugcucaaacgcagagacagcacauacggaccccugcagaccccugucggcugcguucuugggcugguaaauucgucauuguucguggaggauuguaagcucccacugggacaaucuuuaugcgcacugcccgacacaccuaguacucuaaccccauga

SEQ ID NO: 1929 - RNA, 2244 nt, Artificial Sequence
  derived and/or modified CDS sequence (opt3) from MERS-CoV__AHY22565__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuaucauucgcaaaaucuacccugcauucaugcugggcuccucuguaggcaacuuuagcgaugggaagaugggacgauucuuuaaucauacgcuaguucuccugccagacgguuguggcacucuucugcgugccuucuacugcauauuggagcccagauccgggaaccacuguccugcuggaaauucauauaccaguuuugccacauaccauacuccagcgaccgauugcagcgacggcaacuauaauaggaacgcaucucucaauuccuucaaggaauacuucaaccugcggaauuguacauuuauguauaccuacaacauuacggaggaugaaauccuggagugguucgguauuacucagacagcccaaggggugcaccucuuuucaagccgcuaugucgacuuauacggaggcaauauguuccaguuugcuacccugccgguguacgacacuaucaaauauuacaguaucauuccccacucuauaagauccauccagagcgauaggaaggccugggcaucguucuauguguacaaacuucagccuuugacauuucugcuagacuucucugucgauggcuauauucggcgcgcuaucgacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggaccccuccacagguuuacaacuuuaaacgauugguguucacgaauuguaacuacaaucucaccaagcuguuaucucuguucucagucaacgacuuuacaugcagucaaauaagccccgccgcaauugcuuccaauuguuauucuucgcucauccuugauuacuucagcuauccgcuguccaugaagucagacuugagugugucuagcgccggaccuaucucccaguuuaacuacaaacagucauucagcaaucccacuugccuaauucuggcuaccguaccacacaaccucacaacuaucaccaagccucugaaauauucuuacauuaauaagugcuccagacuucugagugaugacaggacagaaguuccccaguuggugaacgccaaucaauauagcccaugugucucuauagugcccuccaccgucugggaggacggcgauuacuaccggaaacagcucucaccucuggaaggugggggcugguuaguggcaaguggaagcacuguugccaugacggagcagcugcagaugggcuuugggaucacagugcaauauggaaccgacacuaacucgguaugcccaaagcuagaguucgcuaaugauaccaaaauugcgucccagcucgguaacugugucgaauacucucuguauggcgugagcgggcguggaguuuuucagaauugcacagcagugggcguccgccagcaaagauucguguacgacgccuaucagaaccuuguagguuacuauucagaugacgggaacuacuacuguuugagggcuugcgugaguguuccggucuccgugaucuaugauaaggagaccaagacucaugccacacuguuuggcucuguggcaugugaacacaucagcuccacgaugucacaguacagccggaguacccgaucuaugcucaaacgcagagacuccacuuauggaccccugcagacaccugucggcugcguucuugggcuggugaauagcucguuguucguggaggauuguaagcucccacugggacaaucauuaugcgcccugcccgacaccccuucuacacuaacuccauga

SEQ ID NO: 1930 - RNA, 2244 nt, Artificial Sequence
  derived and/or modified CDS sequence (opt3) from MERS-CoV__AJG44069__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacggaaauuauuuguggcgaauuauucucaagacguuaagcaguucgcuaacgguuuugugguccgcauaggggccgcagccaauucgacuggaacagugaucauuucacccagcaccagugcuacgauccgaaaaauuuacccugcauucaugcugggcuccucuguaggcaacuuuagcgaugggaagaugggacguuucuuuaaucauacucuaguucuccugccagacgguuguggcacccuucugagagccuucuacugcaucuuggagcccagguccgggaaccacuguccugcuggaaauucauauacaaguuuugccacuuaccauaccccagcgacagauugcagcgacggcaacuauaaucggaacgcaucucucaauuccuucaaggaauacuucaaccugcgcaauuguaccuuuauguauacguacaacauaacugaggaugaaauucuggagugguucgguaucacacagaccgcccagggggugcaccucuuuucaagcagauaugucgacuuauacggaggcaauauguuccaauuugcuacucugccgguguacgacacaauuaaauauuacaguaucaucccccacucuauuagguccauacagagcgaucggaaggccugggcagcuuucuauguguacaaacuucagccuuugaccuuucugcuagacuucucggucgauggcuauauccgccgagccauugacugcggguuuaacgaucucucucagcugcauuguuccuacgagucauucgacguugaaaguggaguguauagcguauccucuuuugaggcgaagccaagcgguucaguggucgaacaagccgagggcguggagugcgauuucaguccccuucuguccgggacgccuccacagguuuacaacuuuaaaagauugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaguccgacuugucagugaguucugcuggaccuaucagccaauuuaacuacaaacaguccuucucaaauccaaccugccuaauccuggccacaguaccccacaaccucacuaccauuacaaagccucugaaauauagcuacaucaauaagugcucuaggcuucuguccgaugaccggaccgaaguuccccaguuggugaacgcaaaucaguauaguccaugugucagcauugugcccucuacugucugggaggacggcgauuacuaccguaaacaacucuccccucuggaaggugggggcugguuaguggccucaggaaguacgguugcuaugacagagcagcugcagaugggcuuugggauaaccgugcaguauggaacugacaccaacagcguaugcccaaagcuagaguucgcgaaugauacaaaaaucgcaucgcaacucgguaacugugucgaauacucccuguauggcgugucugggcgcggaguuuuucagaauugcaccgccgugggcgucagacagcagagguucguguacgacgcuuaucaaaaccuuguagguuacuauagcgaugacgggaacuacuacuguuugcgggccugcgugucaguuccggucagugugauuuaugauaaggagacuaagacacaugcaacgcuguuuggcuccguggccugugaacacaucucuagcaccaugucccaguacucacgaagcacucgcaguaugcucaaaagaagggacucuacauauggaccccugcagaccccugucggcugcguucuugggcugguaaauuccagcuuguucguggaggauuguaagcucccacugggacagucguuaugcgcucugcccgacacaccuucaccacuaacucccuga

SEQ ID NO: 1931 - RNA, 2244 nt, Artificial Sequence
  derived and/or modified CDS sequence (opt3) from MERS-CoV__AJG44080__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauaaagagcgauaggaaagccugggcagcuuucuauguguacaaacuucagccuuugaccuuucugcuagacuucucggucgauggcuauauccggcgcgccauugacugcggguuuaacgaucucucucagcugcauuguuccuacgagucauucgacguugaaaguggaguguauagcguauccucuuuugaggcgaagccaagcgguucaguggucgaacaagccgagggcguggagugcgauuucaguccccuucuguccgggacgccuccacagguuuacaacuuuaagcgauugguguucaccaauuguaacuacaaucucacaaagcuguuaagccuguucucugucaacgacuuuacuugcucacagaucagucccgcagcuauagccagcaauuguuauuccucucucauucuugauuacuucucguauccgcugagcaugaaauccgacuugucagugaguucugcuggaccuaucagccaauuuaacuacaagcaguccuucucaaauccaaccugccuaauccuggccacaguaccccacaaccucacuaccauuacaaaaccucugaaguauagcuacaucaauaaaugcucuagacuucuguccgaugacaggaccgaaguuccccaguuggugaacgcaaaucaguauaguccaugugucagcauugugcccucuacugucugggaggacggcgauuacuaccggaagcaacucuccccucuggaaggugggggcugguuaguggccucaggaaguacgguugcuaugacagagcagcugcagaugggcuuugggauaaccgugcaguauggaacugacaccaacagcguaugcccaaaacuagaguucgcgaaugauacaaagaucgcaucgcaacucgguaacugugucgaauacucccuguauggcgugucugggcguggaguuuuucagaauugcaccgccgugggcguccgccagcagagauucguguacgacgcuuaucaaaaccuuguagguuacuauagcgaugacgggaacuacuacuguuugagggccugcgugucaguuccggucagugugauuuaugauaaggagacuaaaacacaugcaacgcuguuuggcuccguggccugugaacacaucucuagcaccaugucccaguacucacggagcacucgaaguaugcucaagcgcagagacucuacauauggaccccugcagaccccugucggcugcguucuugggcugguaaauuccagcuuguucguggaggauuguaaacucccacugggacagucguuaugcgcucugcccgacacaccuucaccacuaacucccuga

SEQ ID NO: 1932 - RNA, 2244 nt, Artificial Sequence
  derived and/or modified CDS sequence (opt3) from MERS-CoV__AJG44102__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaagccacaaccucacuaccauuacaaagccccugaaauauucuuacaucaauaagugcuccagacuucugagugaugacaggaccgaaguuccucaguuggugaacgcaaaucaauauagccccugugucucuauugugccauccacugucugggaggacggcgauuacuaccggaaacagcucucaccccuggaaggugggggcugguuaguggccaguggaagcacgguugcuaugacagagcagcugcagaugggcuuugggauaaccgugcaauauggaacugacaccaacucgguaugcccuaagcuagaguucgcgaaugauacaaaaaucgcaucccagcucgguaacugugucgaauacucucuguauggcgugagcgggcguggaguuuuucagaauugcaccgccgugggcguccgccagcaaagauucguguacgacgcuuaucagaaccuuguagguuacuauucagaugacgggaacuacuacuguuugagggccugcgugaguguuccagucuccgugauuuaugauaaggagacuaagacacaugcaacgcuguuuggcucuguggccugugaacacaucagcuccaccaucucacaguacagccggaguacucgaucuaugcucaaacgcagagacuccacauauggaccgcugcagacccccgucggcugcguucuugggcuggugaauagcucguuguucguggaggauuguaagcucccucugggacaaucauuaugcgcucugccagacacacccucuacucuaaccccuuga

SEQ ID NO: 1933 - RNA, 2244 nt, Artificial Sequence
  derived and/or modified CDS sequence (opt3) from MERS-CoV__AJG44124__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccauguuccaguacucccggucaacucgaagcaugcucaaacgcagagacaguacauauggaccccugcagaccccugucggcugcguucuugggcuggugaauagcuccuuguuuguggaggauuguaagcucccacugggacaaucuuuaugcgcucugcccgacacaccuucgacucuaaccccauga

SEQ ID NO: 1934 - RNA, 2244 nt, Artificial Sequence
  derived and/or modified CDS sequence (opt3) from MERS-CoV__ALL26396__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuugucgguggaggauuguaagcucccacugggacaaucauuaugcgcucugcccgacacaccuucuacucuaaccccauga

SEQ ID NO: 1935 - RNA, 2244 nt, Artificial Sequence
  derived and/or modified CDS sequence (opt3) from MERS-CoV__ALS20350__S1
augauccacagcguguuccugcucauguuucuucugacccccacagaguccuacgucgacguuggcccugauucugccaagucagcuugcauugaaguggacauacagcaaacuuucuuugauaaaacguggccaagaccgaucgacguaaguaaggcagaugggauuaucuauccccagggaaggaccuacagcaacauuacaaucacuuaucaggguuuguucccuuaccagggcgaccauggggauauguauguguacuccgccggacacgcgaccggcacaaccccacaaaaauuauuugucgcuaauuauucucaggacgugaagcaguucgccaacgguuuuguugugcggauaggggcagccgcuaauucgacuggaacagucaucauuucacccagcaccagugcaacgauccgcaaaauuuacccugccuucaugcugggcuccucugugggcaacuuuagcgaugggaagaugggacgauucuuuaaucauacucuaguacuccugccagacgguuguggcacccuucugcgugcuuucuacugcaucuuggagcccagauccgggaacuauuguccugccggaaauucauacacaaguuuugcgacuuaucacaccccagcaacagauugcagcgacggcaacuacaauaggaacgccucucucaauuccuucaaggaauauuucaaccugcggaauuguaccuuuauguacacguauaacauaacugaggaugaaauucuggagugguucgguaucacacagaccgcucaagggguucaucucuuuucaagccgcuacguggacuuauacggaggcaauauguuccaguuugccacucugccggucuaugacacaauuaaauacuauaguaucaucccccacucuauuagauccauacagagcgauaggaaggcaugggcugccuucuacguguauaaacuucagccuuugaccuuucugcuagacuucucgguggauggcuacauccggcgcgcgauugacugcggguuuaacgaucucucucaacugcacuguuccuaugagucauucgacgucgaaaguggaguuuacagcguguccucuuuugaggccaagccaagcgguucaguaguggaacaggcagagggcgucgagugcgauuucaguccccuucuguccgggacgccuccacagguguacaacuuuaaacgauugguuuucaccaauuguaacuauaaucucacaaagcuguuaagccuguucucugugaacgacuuuacuugcucacaaaucagucccgcugccauagcuagcaauuguuacuccucucucauucuugauuauuucucguacccgcugagcaugaaguccgacuugucagucaguucugccggaccuaucagccaguuuaacuauaaacaguccuucucaaauccaaccugccuaauccuggcaacagugccccauaaccucacuaccauuacaaagccucugaaauacagcuauaucaauaagugcucuagacuucuguccgaugacaggaccgaaguaccccaguugguuaacgccaaucaauacaguccaugugugagcauuguccccucuacugugugggaggacggcgauuacuaucggaaacagcucuccccucuggaaggugggggcugguuagucgcuucaggaaguacgguggcgaugacagagcagcugcagaugggcuuugggauaaccguucaauacggaacugacaccaacagcgugugcccaaagcuagaguucgcaaaugauacaaaaaucgccucgcagcucgguaacuguguagaauauucccuguacggcgucucugggcguggaguguuucagaauugcaccgcuguuggcgugcgccagcaaagauucgucuaugacgccuaccagaaccuuguggguuauuacagcgaugacgggaacuacuauuguuugagggcaugcguaacugugccgguuucagucauuuacgauaaggagacaaagacgcacgccacccuguuuggcaguguggcuugugaacauaucuccucuacuaugagccaguauucccggucaacacgaagcaugcucaaacgcagagacaguaccuacggaccccugcagacaccugugggcugcguccuugggcugguuaauucuuccuuguucguggaggauuguaagcucccacugggacaaagccugugcgcccugcccgacacuccuucgacccuaacgccauga

SEQ ID NO: 1936 - RNA, 2244 nt, Artificial Sequence; identical to SEQ ID NO: 1852
  derived and/or modified CDS sequence (opt3) from MERS-CoV__ALT66880__S1

SEQ ID NO: 1937 - RNA, 2244 nt, Artificial Sequence
  derived and/or modified CDS sequence (opt3) from MERS-CoV__ALA49341__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccuuacaaaaacuguuuguggcgaauuauucucaggacguuaagcaguucgcuaacgguuuugugguccggauaggggccgcagccaauucgacuggaacagugaucauuucaccaagcaccagugcuacgauccgcaaaauuuaccccgcauucaugcuaggcuccucuguaggcaacuuuagcgaugggaagaugggacgauucuuuaaucauacucucguucugcuuccugacgguuguggcacccuguugcgugccuucuacugcauccucgagccaagauccgggaaccacugucccgcuggaaauucauauacaaguuuugccacuuaccauaccccugcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcacuuauuuucaagccgcuaugucgaccuguacggaggcaauauguuccaguuugcuacucuuccaguguacgacacaauuaaauauuacaguaucaucccgcacucuauuagauccauacagagcgauaggaaggccugggcagcuuucuauguguacaaauugcagccccugaccuuucuacucgacuucucggucgauggcuauauccggcgcgccauugacugcggguuuaacgaucugucucaacuucauuguuccuacgagucauucgacguugaaaguggaguguauagcguauccucuuuugaggcgaagccuagcgguucaguggucgaacaggccgagggcguggagugcgauuucaguccacuguuguccgggacgcccccucagguuuacaacuuuaaacgacucguguucaccaauuguaacuacaaucugacaaaguuacugagccucuucucugucaacgacuuuaucugcucacaaauaaguccagcagcuauugccagcaauuguuauuccucucuuauccuggauuacuucucguaucccuugagcaugaaguccgaccuaucagugaguucugcuggaccgaucagccaguuuaacuacaaacaguccuucucaaauccuacuugccugauucucgccaccguaccccacaaccugacaacuaucaccaagccacuuaaauauagcuacauuaauaagugcucuagacuguuguccgaugacaggacagaaguuccucagcucgugaacgcaaaucaauauagucccugugucagcauagugccaucuaccgucugggaggacggcgauuacuaccggaaacagcugucccccuuagaaggugggggcuggcugguggccucaggaaguacuguugcuaugacggagcagcuacagaugggcuuugggaucacagugcaauauggaaccgacacuaacagcguaugcccuaagcucgaguucgcgaaugauaccaaaauugcaucgcagcuggguaacugugucgaauacucccuuuauggcgugucugggcguggaguuuuucagaauugcacagccgugggcguccgccagcaaagauucguguacgacgcuuaucagaacuugguagguuacuauagcgaugacgggaacuacuacugucugagggccugcgugucaguuccagucagugugaucuaugauaaggagaccaagacucaugcaacacucuuuggcuccguggccugugaacacaucucuagcacgaugucccaguacucacggagcacccgaaguaugcugaaacgcagagacucuacuuauggaccgcuucagacacccgucggcugcguucugggguugguaaauuccagccucuucguggaggauuguaagcugccuuuaggacaaucgcugugcgcucuaccagacacccccucaacacucacuccuuga

SEQ ID NO: 1938 - RNA, 2244 nt, Artificial Sequence
  derived and/or modified CDS sequence (opt3) from MERS-CoV__ALA49352__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuacuauaccccagcgacagauugcagcgacggcaacuacaauaggaacgcaucucucaauuccuucaaggaauauuucaaccugcggaauuguaccuuuauguacacguauaacauaacugaggaugaaauucuggagugguucgguaucacacagaccgcccaaggggugcaucucuuuucaagccgcuacgucgacuuauacggaggcaauauguuccaguuugcuacucugccgguguaugacacaauuaaauacuauaguaucaucccccacucuauuagauccauacagagcgauaggaaggccugggcagcuuucuacguguauaaacuucagccuuugaccuuucugcuagacuucucggucgauggcuacauccggcgcgccauugacugcggguuuaacgaucucucucaacugcacuguuccuaugagucauucgacguugaaaguggaguguacagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuauaaucucacaaagcuguuaagccuguucucugucaacgacuuuacuugcucacaaaucagucccgcagcuauagccagcaauuguuacuccucucucauucuugauuauuucucguacccgcugagcaugaaguccgacuugucagugaguucugcuggaccuaucagccaguuuaacuauaaacaguccuucucaaauccaaccugccuaauccuggccacaguaccccauaaccucacuaccauuacaaagccucugaaauacagcuauaucaauaagugcucuagacuucuguccgaugacaggaccgaaguuccccaguuggugaacgcaaaucaauacaguccaugugucagcauugugcccucuacugucugggaggacggcgauuacuaucggaaacagcucuccccucuggaaggugggggcugguuaguggccucaggaaguacgguugcuaugacagagcagcugcagaugggcuuugggauaaccgugcaauacggaacugacaccaacagcguaugcccaaagcuagaguucgcgaaugauacaaaaaucgcaucgcagcucgguaacugugucgaauauucccuguacggcgugucugggcguggaguuuuucagaauugcaccgccgugggcguccgccagcaaagauucguguaugacgcuuaccagaaccuuguagguuauuacagcgaugacgggaacuacuauuguuugagggccugcgugucaguuccggucagugugauuuacgauaaggagacuaagacacacgcaacgcuguuuggcuccguggccugugaacauaucucuagcaccaugucccaguauucacggagcacucgaaguaugcucaaacgcagagacucuacauacggaccccugcagaccccugucggcugcguucuugggcugguaaauuccagcuuguucguggaggauuguaagcucccacugggacaaucguuaugcgcucugcccgacacaccuucaacucuaaccccauga

SEQ ID NO: 1939 - RNA, 2244 nt, Artificial Sequence
  derived and/or modified CDS sequence (opt3) from MERS-CoV__ALA49363__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacuuucccgguguacgacacaauuaaauauuacaguaucaucccccacucuauuagauccauacagagcgauaggaaggccugggcagcuuuuuauguguacaaacugcagccucuuaccuucuugcuggacuuuucggucgauggcuauauccggcgcgccauugacugcggguucaacgaucuaucucaacuccauuguuccuacgagucauuugacguugaaaguggaguguauagcguauccucuuucgaggcgaagccaagcgguucaguggucgaacaggccgagggcguggagugcgauuuuaguccccugcuuuccgggacgccuccacagguuuacaacuucaaacgacugguguucaccaauuguaacuacaauuugacaaagcuccugagcuuauuuucugucaacgacuucacuugcucacaaaucagucccgcagcuauagccagcaauuguuauuccucucugauucucgauuacuuuucguauccgcuuagcaugaaguccgaccugucagugaguucugcuggaccuaucagccaguucaacuacaaacaguccuuuucaaauccaaccugcuugauccuagccacaguaccccacaaccugacuaccauuacaaagccucucaaauauagcuacaucaauaagugcucuagacugcuuuccgaugacaggaccgaaguuccccagcuggugaacgcaaaucaauauaguccaugugucagcauugugcccucuacugucugggaggacggcgauuacuaccggaaacaguuguccccucucgaaggugggggcuggcugguggccucaggaaguacgguugcuaugacagagcaguuacagaugggcuucgggauaaccgugcaauauggaacugacaccaacagcguaugcccaaagcuggaauuugcgaaugauacaaaaaucgcaucgcagcuagguaacugugucgaguacucccucuauggcgugucugggcguggaguuuuccagaauugcaccgccgugggcguccgccagcaaagauuuguguacgacgcuuaucagaaccugguagguuacuauagcgaugacgggaacuacuacugucuuagggccugcgugucaguuccggucagugugauuuaugauaaggagacuaagacacaugcaacguuguucggcuccguggccugugaacacaucucuagcaccaugucccaguacucacggagcacucgaaguaugcugaaacgcagagacucuacauauggaccccuccagaccccugucggcugcguucuggggcuuguaaauuccagccuguuuguggaggauuguaaguugccacucggacaaucgcugugcgcuuuacccgacacaccuucaacucugaccccauga

SEQ ID NO: 1940 - RNA, 2244 nt, Artificial Sequence; identical to SEQ ID NO: 1872
  derived and/or modified CDS sequence (opt3) from MERS-CoV__ALA49374__S1

SEQ ID NO: 1941 - RNA, 2244 nt, Artificial Sequence
  derived and/or modified CDS sequence (opt3) from MERS-CoV__ALA49396__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccucaagcaauccaaccugccuaauccuggccacaguaccccacaaccucacuaccauuacaaagccucugaaauauucuuacaucaauaagugcuccagacuucugagugaugacaggaccgaaguuccccaguuggugaacgcaaaucaauauagcccaugugucucuauugugcccuccacugucugggaggacggcgauuacuaccggaaacagcucucaccucuggaaggugggggcugguuaguggccaguggaagcacgguugcuaugacagagcagcugcagaugggcuucgggauaaccgugcaauauggaacugacaccaacucgguaugcccaaagcuagaauuugcgaaugauacaaaaaucgcaucccagcucgguaacugugucgaguacucucuguauggcgugagcgggcguggaguuuuccagaauugcaccgccgugggcguccgccagcaaagauuuguguacgacgcuuaucagaaccuuguagguuacuauucagaugacgggaacuacuacuguuugagggccugcgugaguguuccggucuccgugauuuaugauaaggagacuaagacacaugcaacgcuguucggcucuguggccugugaacacaucagcuccaccaugucacaguacagccggaguacucgaucuaugcucaaacgcagagacuccacauauggaccccugcagaccccugucggcugcguucuugggcuggugaauagcucguuguuuguggaggauuguaagcucccacugggacaaucauuaugcgcucugcccgacacaccuucuacucuaaccccauga

SEQ ID NO: 1942 - RNA, 2244 nt, Artificial Sequence
  derived and/or modified CDS sequence (opt3) from MERS-CoV__ALA49451__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucugcuggaccuaucagccaguuuaacuacaaacaguccuucucaaauccaaccugccuaauccuggccacaguaccccacaaccucacuaccauuacaaagccucugaaauauagcuacaucaauaagugcucuagacuucuguccgaugacaggaccgaaguuccccaguuggugaacgcaaaucaauauaguccaugugucagcauugugcccucuacugucugggaggacggcgauuacuaccggaaacagcucuccccucuggaaggugggggcugguuaguggccucaggaaguacgguugcuaugacagagcagcugcagaugggcuuugggauaaccgugcaauauggaacugacaccaacagcguaugcccaaagcuagaguucgcgaaugauacaaaaaucgcaucgcagcucgguaacugugucgaauacucccuguauggcgugucugggcguggaguuuuucagaauugcaccgccgugggcguccgccagcaaagauucguguacgacgcuuaucagaaccuuguagguuacuauagcgaugacgggaacuacuacuguuugagggccugcgugucaguuccggucagugugauuuaugauaaggagacuaagacacaugcaacgcuguuuggcuccguggccugugaacacaucucuagcaccaugucccaguacucacggagcacucgaaguaugcucaaacgcagagacucuacauauggaccccugcagaccccugucggcugcguucuugggcugguaaauuccagcuuguucguggaggauuguaaccucccacugggacaaucguuaugcgcucugcccgacacaccuucaacucuaaccccauga

SEQ ID NO: 1943 - RNA, 2244 nt, Artificial Sequence
  derived and/or modified CDS sequence (opt3) from MERS-CoV__ALA49473__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccaacaaccgauugcagcgacggcaacuauaauaggaacgcgucucucaauuccuucaaggaauacuucaaccugcggaauuguacguuuauguauacuuacaacauaacagaggaugaaauucuggagugguucgguaucacccagacugcacaaggggugcaccucuuuucaagccgcuaugucgacuuauacggaggcaauauguuccaguuugccacacugccgguguacgacaccauuaaauauuacaguaucaucccccacucuauuagauccauacagagcgauaggaaggcuugggccgcauucuauguguacaaacuucagccuuugacguuucugcuagacuucucggucgauggcuauauccggcgcgcuauugacugcggguuuaacgaucucucucaacugcauuguuccuacgagucauucgacguugaaaguggaguguauagcguauccucuuuugaggccaagccaagcgguucaguggucgaacaggcggagggcguggagugcgauuucaguccccuucuguccgggaccccuccacagguuuacaacuuuaaacgauugguguucacaaauuguaacuacaaucucacuaagcuguuaagccuguucucugucaacgacuuuaccugcucacaaaucagucccgccgcaauagcuagcaauuguuauuccucucucauucuugauuacuucucguauccgcugagcaugaaguccgacuugucagugaguucugccggaccuaucagccaguuuaacuacaaacaguccuucucaaaucccacaugccuaauccuggcuacuguaccacacaaccucaccacaauuaccaagccucugaaauauagcuacaucaauaagugcucuagacuucuguccgaugacaggacugaaguuccccaguuggugaacgccaaucaauauaguccaugugucagcauugugcccucuacggucugggaggacggcgauuacuaccggaaacagcucuccccucuggaaggugggggcugguuaguggcaucaggaaguacaguugccaugaccgagcagcugcagaugggcuuugggauaacugugcaauauggaaccgacacaaacagcguaugcccaaagcuagaguucgcuaaugauaccaaaaucgcgucgcagcucgguaacugugucgaauacucccuguauggcgugucugggcguggaguuuuucagaauugcacugcagugggcguccgccagcaaagauucguguacgacgccuaucagaaccuuguagguuacuauagcgaugacgggaacuacuacuguuugagggcuugcgugucaguuccggucagugugauuuaugauaaggagacaaagacgcaugccacccuguuuggcuccguggcaugugaacacaucucuagcacuaugucccaguacucacggagcacacgaaguaugcucaaacgcagagacucuaccuauggaccccugcagacaccugucggcugcguucuugggcugguaaauuccagcuuguucguggaggauuguaagcucccacugggacaaucguuaugcgcccugcccgacacuccuucaacccuaacgccauga

SEQ ID NO: 1944 - RNA, 2244 nt, Artificial Sequence; identical to SEQ ID NO: 1852
  derived and/or modified CDS sequence (opt3) from MERS-CoV__ALA49583__S1

SEQ ID NO: 1945 - RNA, 2244 nt, Artificial Sequence
  derived and/or modified CDS sequence (opt3) from MERS-CoV__ALA49649__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaacccccaaaaaguuauuuguggcgaauuauucucaagacguuaaacaguucgcuaacgguuuugugguccggauaggggccgcagccaauucgacuggaacagugaucauuucacccagcaccagugcuacgauccgcaagauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaagaauacuucaaccugcggaauuguaccuuuauguauacguacaacauaacugaggaugaaauucuggagugguucgguaucacacagaccgcccagggggugcaccucuuuucaagccgcuaugucgacuuauacggaggcaauauguuccaauuugcuacucugccgguguacgacacaauuaaguauuacaguaucaucccccacucuauuagauccauacagagcgauaggaaagccugggcagcuuucuauguguacaaacuucagccuuugaccuuucugcuagacuucucggucgauggcuauauccggcgcgccauugacugcggguuuaacgaucucucucagcugcauuguuccuacgagucauucgacguugaaaguggaguguauagcguauccucuuuugaggcgaucccaagcgguucaguggucgaacaagccgagggcguggagugcgauuucaguccccuucuguccgggacgccuccacagguuuacaacuuuaagcgauugguguucaccaauuguaacuacaaucucacaaagcuguuaagccuguucucugucaacgacuuuacuugcucacagauaagucccgcagcuauugccagcaauuguuauuccucucucauccuugauuacuucucguauccgcugagcaugaaguccgacuugucagugaguucugcuggaccuaucagccaauuuaacuacaaacaguccuucucaaauccaaccugccuaauucuggccacaguaccacacaaccucacuaccaucacaaagccucugaaauauagcuacauuaauaagugcucuagacuucuguccgaugacaggaccgaaguuccccaguuggugaacgcaaaucaguauaguccaugugucagcauagugcccucuacugucugggaggacggcgauuacuaccggaaacaacucuccccucuggaaggugggggcugguuaguggccucaggaaguacgguugcuaugacagagcagcugcagaugggcuuugggaucaccgugcaguauggaacugacaccaacagcguaugcccaaagcuagaguucgcgaaugauacaaaaauugcaucgcaacucgguaacugugucgaauacucccuguauggcgugucugggcguggaguuuuucagaauugcaccgccgugggcguccgccagcagagauucguguacgacgcuuaucauaaccuuguagguuacuauagcgaugacgggaacuacuacuguuugagggccugcgugucaguuccggucagugugaucuaugauaaggagacuaagacacacgcaacgcuguuuggcuccguggccugugaacacaucucuagcaccaugucccaauacucacggagcacucgaaguaugcucaaacgcagagacucuacauauggaccccugcagaccccugucggcugcguucuugggcugguaaauuccagcuuguucguggaggauuguaagcucccacugggacagucguuaugcgcucugcccgacacaccuucaacucuaaccccauga

SEQ ID NO: 1946 - RNA, 2244 nt, Artificial Sequence
  derived and/or modified CDS sequence (opt3) from MERS-CoV__ALA49660__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaauucuacccugcauuuaugcugggcuccucuguaggcaacuucagcgaugggaagaugggacgauuuuucaaucauacucuaguucuccugccagacgguuguggcacccuucugcgugccuuuuacugcauuuuggagcccagauccgggaaccacuguccugcuggaaauucauauacaaguuucgccacuuaccauaccccagcgacagauugcagcgacggcaacuauaauaggaacgcaucucucaauuccuucaaggaauacuuuaaccugcggaauuguaccuucauguauacguacaacaucacugaggaugaaauacuggagugguuugguauuacacagaccgcccaaggggugcaccucuucucaagccgcuaugucgacuuauacggaggcaauauguuucaguucgcuacucugccgguguacgacacaaucaaauauuacaguauuaucccccacucuaucagauccauucagagcgauaggaaggccugggcagcuuuuuauguguacaaacuucagccuuugaccuuccugcuagacuuuucggucgauggcuauauacggcgcgccaucgacugcggguucaacgaucucucucaacugcauuguuccuacgagucauuugacguugaaaguggaguguauagcguauccucuuucgaggcgaagccaagcgguucaguggucgaacaggccgagggcguggagugcgauuuuaguccccuucuguccgggacgccuccacagguuuacaacuucaaacgauugguguucaccaauuguaacuacaaucucacaaagcuguuaagccuguuuucugucaacgacuucacuugcucacaaauuagucccgcagcuaucgccagcaauuguuauuccucucucauacuugauuacuuuucguauccgcugagcaugaaguccgacuugucagugaguucugcuggaccuauuagccaguucaacuacaaacaguccuuuucaaauccaaccugccuaauccuggccacaguaccccacaaccucacuaccaucacaaagccucugaaauauagcuacauuaauaagugcucuagacuucuguccgaugacaggaccgaaguuccccaguuggugaacgcaaaucaauauaguccaugugucagcaucgugcccucuacugucugggaggacggcgauuacuaccggaaacagcucuccccucuggaaggugggggcugguuaguggccucaggaaguacgguugcuaugacagagcagcugcagaugggcuucgggauuaccgugcaauauggaacugacaccaacagcguaugcccaaagcuagaauuugcgaaugauacaaaaauagcaucgcagcucgguaacugugucgaguacucccuguauggcgugucugggcguggaguuuuccagaauugcaccgccgugggcguccgccagcaaagauuuguguacgacgcuuaucagaaccuuguagguuacuauagcgaugacgggaacuacuacuguuugagggccugcgugucaguuccggucagugugaucuaugauaaggagacuaagacacaugcaacgcuguucggcuccguggccugugaacacauuucuagcaccaugucccaguacucacggagcacucgaaguaugcucaaacgcagagacucuacauauggaccccugcagaccccugucggcugcguucuugggcugguaaauuccagcuuguuuguggaggauuguaagcucccacugggacaaucguuaugcgcucugcccgacacaccuucaacucuaaccccauga

SEQ ID NO: 1947 - RNA, 2244 nt, Artificial Sequence
  derived and/or modified CDS sequence (opt3) from MERS-CoV__ALA49671__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacaaacugcagcgauggcaauuauaacaggaaugcaucucucaacuccuucaaggaauacuucaaucugcggaacuguaccuuuauguauacguacaauauaacugaggacgaaauucuggagugguucgguaucacacagaccgcccaaggggugcaccucuuuucaagccgcuaugucgauuuauacggaggcaacauguuccaguuugcuacucugccgguguacgacacaauuaaauauuacaguaucaucccccacucuauuagauccauacagagcgacaggaaggccugggcagcuuucuauguguacaaacuucagccuuugaccuuucugcuagauuucucggucgacggcuauauccggcgcgccauugauugcggguuuaacgaccucucucaacugcauuguuccuacgagucauucgauguugaaaguggaguguauagcguauccucuuuugaggcgaagccaagcgguucaguggucgaacaggccgagggcguggagugcgacuucaguccccuucuguccgggacgccuccacagguuuacaauuuuaaacgauugguguucaccaacuguaauuacaaccucacaaagcuguuaagccuguucucugucaaugauuuuacuugcucacaaaucagucccgcagcuauagccagcaacuguuauuccucucucauucuugacuacuucucguauccgcugagcaugaaguccgauuugucagugaguucugcuggaccuaucagccaguuuaauuacaaacaguccuucucaaacccaaccugccuaauccuggccacaguaccccacaaucucacuaccauuacaaagccucugaaauauagcuacaucaacaagugcucuagacuucuguccgacgauaggaccgaaguuccccaguuggugaaugcaaaccaauauaguccaugugucagcauugugcccucuacugucugggaggacggcgacuacuaccggaaacagcucuccccucuggaaggugggggcugguuaguggccucaggaaguacgguugcuaugacagagcagcugcagaugggcuuugggauaaccgugcaauauggaacugauaccaauagcguaugcccaaagcuagaguucgcgaacgacacaaaaaucgcaucgcagcucgguaauugugucgaauacucccuguauggcgugucugggcguggaguuuuucagaacugcaccgccgugggcguccgccagcaaagauucguguacgaugcuuaucagaaccuuguagguuacuauagcgacgaugggaauuacuacuguuugagggccugcgugucaguuccggucagugugauuuaugacaaggagacuaagacacaugcaacgcuguuuggcuccguggccugugaacacaucucuagcaccaugucccaguacucacggagcacucgaaguaugcucaaacgcagagauucuacauauggaccccugcagaccccugucggcugcguucuugggcuggugaacuccagcuuguucguggaggacuguaagcucccacugggacaaucguuaugcgcucugcccgauacaccuucaacucuaaccccauga

SEQ ID NO: 1948 - RNA, 2244 nt, Artificial Sequence; identical to SEQ ID NO: 1852
  derived and/or modified CDS sequence (opt3) from MERS-CoV__ALA49682__S1

SEQ ID NO: 1949 - RNA, 2244 nt, Artificial Sequence
  derived and/or modified CDS sequence (opt3) from MERS-CoV__ALA49803__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggaucgguaugucuacuccgcaggacacgccaccggcacaaccccacaaaaauuauuuguggcgaauuauucucaggacguuaagcaguucgcuaacgguuuugugguccgcauaggggccgcagccaauucgacuggaacagugaucauuucacccagcaccagugcuacgauccgaaaaauuuacccugcauucaugcugggcuccucuguaggcaacuuuagcgaugggaagaugggacguuucuuuaaucauacucuaguucuccugccagacgguuguggcacccuucugagagccuucuacugcaucuuggagcccagguccgggaaccacuguccugcuggaaauucauauacaaguuuugccacuuaccauaccccaagcacagauugcucugacggcaacuauaaucggaacgcgucccucaauucauucaaggaauacuucaaccugcgcaauuguaccuuuauguauacguacaacauaacugaggaugaaauucuggagugguucgguaucacacagaccgcacaaggggugcaccucuuuagcaguagauaugucgacuuauacggaggcaauauguuccaguuugccacucugccgguguacgacacaauuaaauauuacucuaucaucccccacuccauuaggagcauacagucggaucggaaggcuugggccgcauucuauguguacaaacuucagccuuugaccuuucugcuagacuucucugucgauggcuauauccgccgagcuauugacugcggguuuaacgaucucucccaacugcauuguucauacgagaguuucgacguugaaagcggaguguauuccguaucuagcuuugaggccaagccaucagguaguguggucgaacaggcggagggcguggagugcgauuucagcccccuucuguccgggacgccuccacagguuuacaacuuuaaaagauugguguucaccaauuguaacuacaaucucacaaagcuguuaucucuguucucagucaacgacuuuacuugcagucaaaucagccccgccgcaauagcuuccaauuguuauucuucgcucauucuugauuacuucagcuauccgcuguccaugaagucagacuugagugugucuagcgccggaccuaucucccaguuuaacuacaaacagucauucagcaauccaaccugccuaauccuggcuacaguaccccacaaccucacuaccauuacaaagccucugaaauauucuuacaucaauaagugcuccaggcuucugagugaugaccggaccgaaguuccccaguuggugaacgccaaucaauauagcccaugugucucuauugugcccuccacugucugggaggacggcgauuacuaccguaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcgcggaguuuuucagaauugcaccgcagugggcgucagacagcaaagguucguguacgacgccuaucagaaccuuguagguuacuauucagaugacgggaacuacuacuguuugcgggcuugcgugaguguuccggucuccgugauuuaugauaaggagacuaagacacaugccacgcuguuuggcucuguggcaugugaacacaucagcuccaccaugucacaguacagccgaaguacucgcucuaugcucaaaagaagggacuccacauauggaccccugcagaccccugucggcugcguucuugggcuggugaauagcucguuguucguggaggauuguaagcucccacugggacaaucauuaugcgcccugcccgacacaccuucuacucuaaccccauga

SEQ ID NO: 1950 - RNA, 2244 nt, Artificial Sequence; identical to SEQ ID NO: 1941
  derived and/or modified CDS sequence (opt3) from MERS-CoV__ALA49836__S1

SEQ ID NO: 1951 - RNA, 2244 nt, Artificial Sequence; identical to SEQ ID NO: 1852
  derived and/or modified CDS sequence (opt3) from MERS-CoV__ALA49957__S1

SEQ ID NO: 1952 - RNA, 2244 nt, Artificial Sequence
  derived and/or modified CDS sequence (opt3) from MERS-CoV__ALA50067__S1
augauccacagcguguuccugcucauguuucuucugacccccacagaguccuacgucgacguuggcccugauucugugaagucagccugcauugaaguagacauacagcaaacuuucuuugauaaaacguggccaagaccgaucgacgugaguaaggcugaugggauuaucuauccccagggaaggaccuacagcaacauuacaaucacuuaucaggguuuguucccuuaccagggcgaccauggggauauguaugucuacuccgcaggacacgccaccggcacaaccccacaaaaauuauuuguggcgaauuauucucaggacguuaagcaguucgcuaacgguuuugugguccggauaggggccgcagccaauucgacuggaacagugaucauuucacccagcaccagugcuacgauccgcaaaauuuacccugcauucaugcugggcuccucuguaggcaacuuuagcgaugggaagaugggacgauucuuuaaucauacucuaguucuccugccagacgguuguggcacccuucugcgugccuucuacugcaucuuggagcccagauccgggaaccacuguccugcuggaaauucauauacaaguuuugccacuuaccauaccccagcgacagauugcagcgacggcaacuauaauaggaacgcaucucucaauuccuucaaggaauacuucaaccugcggaauuguaccuuuauguauacguacaacauaacugaggaugaaauucuggagugguucgguaucacacagaccgcccaaggggugcaccucuuuucaagccgcuaugucgacuuauacggaggcaauauguuccaguuugcuacucugccgguguacgacacaauuaaauauuacaguaucaucccccacucuauuagauccauacagagcgauaggaaggccugggcagcuuucuauguguacaaacuucagccuuugaccuuucugcuagacuucucggucgauggcuauauccggcgcgccauugacugcggguuuaacgaucucucucaacugcauuguuccuacgagucauucgacguugaaaguggaguguauagcguauccucuuuugaggcgaagccaagcgguucaguggucgaacaggccgagggcguggagugcgauuucaguccccuucuguccgggacgccuccacagguuuacaacuuuaaacgauugguguucaccaauuguaacuacaaucucacaaagcuguuaagccuguucucugucaacgacuuuacuugcucacaaaucagucccgcagcuauagccagcaauuguuauuccucucucauucuugauuacuucucguauccgcugagcaugaaguccgacuugucagugaguucuagcggaccuaucucccaguuuaacuacaaacagucauucagcaauccaaccugccuaauccuggcuacaguaccccacaaccucacuaccauuacaaagccucugaaauauucuuacaucaauaagugcuccagacuucugagugaugacaggaccgaaguuccccaguuggugaacgccaaucaauauagcccaugugucucuauugugcccuccacugucugggaggacggcgauuacuaccggaaacagcucucaccucuggaaggugggggcugguuaguggcaaguggaagcacgguugccaugacagagcagcugcagaugggcuuugggauaaccgugcaauauggaacugacaccaacucgguaugcccaaagcuagaguucgcuaaugauacaaaaaucgcgucccagcucgguaacugugucgaauacucucuguauggcgugagcgggcguggaguuuuucagaauugcaccgcagugggcguccgccagcaaagauucguguacgacgccuaucagaaccuuguagguuacuauucagaugacgggaacuacuacuguuugagggcuugcgugaguguuccggucuccgugauuuaugauaaggagacuaagacacaugccacgcuguuuggcucuguggcaugugaacacaucagcuccaccaugucacaguacagccggaguacucgaucuaugcucaaacgcagagacuccacauauggaccccugcagaccccugucggcugcguucuugggcuggugaauagcucguuguucguggaggauuguaagcucccacugggacaaucauuaugcgcccugcccgacacaccuucuacucuaaccccauga

SEQ ID NO: 1953 - RNA, 2244 nt, Artificial Sequence
  derived and/or modified CDS sequence (opt4) from MERS-CoV__AFS88936__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1954 - RNA, 2244 nt, Artificial Sequence
  derived and/or modified CDS sequence (opt4) from MERS-CoV__AFY13307__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagauuccugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1955 - RNA, 2244 nt, Artificial Sequence
  derived and/or modified CDS sequence (opt4) from MERS-CoV__AGH58717__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccgugaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcauccugagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1956 - RNA, 2244 nt, Artificial Sequence
  derived and/or modified CDS sequence (opt4) from MERS-CoV__AGN52936__S1
augauccacagcguguuccugcugauguuccugcugacccccaccgagagcuacguggacgugggccccgacagcaucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1957 - RNA, 2244 nt, Artificial Sequence; identical to SEQ ID NO: 1953
  derived and/or modified CDS sequence (opt4) from MERS-CoV__AGN70951__S1

SEQ ID NO: 1958 - RNA, 2244 nt, Artificial Sequence
  derived and/or modified CDS sequence (opt4) from MERS-CoV__AGV08408__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcggcgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1959 - RNA, 2244 nt, Artificial Sequence
  derived and/or modified CDS sequence (opt4) from MERS-CoV__AGV08455__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcuacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1960 - RNA, 2244 nt, Artificial Sequence; identical to SEQ ID NO: 1953
  derived and/or modified CDS sequence (opt4) from MERS-CoV__AGV08467__S1

SEQ ID NO: 1961 - RNA, 2244 nt, Artificial Sequence; identical to SEQ ID NO: 1953
  derived and/or modified CDS sequence (opt4) from MERS-CoV__AGV08492__S1

SEQ ID NO: 1962 - RNA, 2244 nt, Artificial Sequence
  derived and/or modified CDS sequence (opt4) from MERS-CoV__AGV08584__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgccugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1963 - RNA, 2244 nt, Artificial Sequence
  derived and/or modified CDS sequence (opt4) from MERS-CoV__AHB33326__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccuacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1964 - RNA, 2244 nt, Artificial Sequence
  derived and/or modified CDS sequence (opt4) from MERS-CoV__AHC74088__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcuucgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1965 - RNA, 2244 nt, Artificial Sequence
  derived and/or modified CDS sequence (opt4) from MERS-CoV__AHI48528__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagcccccccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggugaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1966 - RNA, 2244 nt, Artificial Sequence; identical to SEQ ID NO: 1953
  derived and/or modified CDS sequence (opt4) from MERS-CoV__AHI48550__S1

SEQ ID NO: 1967 - RNA, 2244 nt, Artificial Sequence
  derived and/or modified CDS sequence (opt4) from MERS-CoV__AHI48583__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacguguucaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1968 - RNA, 2244 nt, Artificial Sequence; identical to SEQ ID NO: 1953
  derived and/or modified CDS sequence (opt4) from MERS-CoV__AHI48605__S1

SEQ ID NO: 1969 - RNA, 2244 nt, Artificial Sequence; identical to SEQ ID NO: 1955
  derived and/or modified CDS sequence (opt4) from MERS-CoV__AHY21469__S1

SEQ ID NO: 1970 - RNA, 2244 nt, Artificial Sequence
  derived and/or modified CDS sequence (opt4) from MERS-CoV__AHZ64057__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucuucagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1971 - RNA, 2244 nt, Artificial Sequence; identical to SEQ ID NO: 1953
  derived and/or modified CDS sequence (opt4) from MERS-CoV__AID50418__S1

SEQ ID NO: 1972 - RNA, 2244 nt, Artificial Sequence; identical to SEQ ID NO: 1953
  derived and/or modified CDS sequence (opt4) from MERS-CoV__AID55068__S1

SEQ ID NO: 1973 - RNA, 2244 nt, Artificial Sequence
  derived and/or modified CDS sequence (opt4) from MERS-CoV__AID55073__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1974 - RNA, 2244 nt, Artificial Sequence
  derived and/or modified CDS sequence (opt4) from MERS-CoV__AIY60528__S1
augauccacagcguguuccugcugauguuccugcugacccccaccgagagcuacguggacgugggccccgacagcuucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccagaacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1975 - RNA, 2244 nt, Artificial Sequence
  derived and/or modified CDS sequence (opt4) from MERS-CoV__AIY60558__S1
augauccacagcguguuccugcugauguuccugcugacccccaccgagagcuacguggacgugggccccgacagcuucaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1976 - RNA, 2244 nt, Artificial Sequence; identical to SEQ ID NO: 1953
  derived and/or modified CDS sequence (opt4) from MERS-CoV__AIZ74450__S1

SEQ ID NO: 1977 - RNA, 2244 nt, Artificial Sequence
  derived and/or modified CDS sequence (opt4) from MERS-CoV__AJD81440__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucaaccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1978 - RNA, 2244 nt, Artificial Sequence; identical to SEQ ID NO: 1953
  derived and/or modified CDS sequence (opt4) from MERS-CoV__AKI29284__S1

SEQ ID NO: 1979 - RNA, 2244 nt, Artificial Sequence
  derived and/or modified CDS sequence (opt4) from MERS-CoV__AKL59401__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagagccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcauccugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1980 - RNA, 2244 nt, Artificial Sequence
  derived and/or modified CDS sequence (opt4) from MERS-CoV__AKM76229__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccuga

SEQ ID NO: 1981 - RNA, 2244 nt, Artificial Sequence
  derived and/or modified CDS sequence (opt4) from MERS-CoV__AKM76239__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgagcugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1982 - RNA, 2244 nt, Artificial Sequence
  derived and/or modified CDS sequence (opt4) from MERS-CoV__AKN11072__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaccgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1983 - RNA, 2244 nt, Artificial Sequence
  derived and/or modified CDS sequence (opt4) from MERS-CoV__AKN11074__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaccgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagcacuucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1984 - RNA, 2244 nt, Artificial Sequence
  derived and/or modified CDS sequence (opt4) from MERS-CoV__AKN24803__S1
auggugcacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugagccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1985 - RNA, 2244 nt, Artificial Sequence
  derived and/or modified CDS sequence (opt4) from MERS-CoV__AKN24812__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucugcguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1986 - RNA, 2244 nt, Artificial Sequence
  derived and/or modified CDS sequence (opt4) from MERS-CoV__AKN24830__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggccccaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1987 - RNA, 2244 nt, Artificial Sequence; identical to SEQ ID NO: 1953
  derived and/or modified CDS sequence (opt4) from MERS-CoV__ALB08257__S1

SEQ ID NO: 1988 - RNA, 2244 nt, Artificial Sequence
  derived and/or modified CDS sequence (opt4) from MERS-CoV__ALB08311__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggcuacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1989 - RNA, 2244 nt, Artificial Sequence; identical to SEQ ID NO: 1988
  derived and/or modified CDS sequence (opt4) from MERS-CoV__ALB08322__S1

SEQ ID NO: 1990 - RNA, 2244 nt, Artificial Sequence; identical to SEQ ID NO: 1953
  derived and/or modified CDS sequence (opt4) from MERS-CoV__ALD51904__S1

SEQ ID NO: 1991 - RNA, 2244 nt, Artificial Sequence
  derived and/or modified CDS sequence (opt4) from MERS-CoV__ALJ54446__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacuucuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1992 - RNA, 2244 nt, Artificial Sequence
  derived and/or modified CDS sequence (opt4) from MERS-CoV__ALJ54448__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccauccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1993 - RNA, 2244 nt, Artificial Sequence
  derived and/or modified CDS sequence (opt4) from MERS-CoV__ALJ54450__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagauacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1994 - RNA, 2244 nt, Artificial Sequence
  derived and/or modified CDS sequence (opt4) from MERS-CoV__ALJ54453__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1995 - RNA, 2244 nt, Artificial Sequence
  derived and/or modified CDS sequence (opt4) from MERS-CoV__ALJ54455__S1
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaagcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccuga

SEQ ID NO: 1996 - RNA, 2244 nt, Artificial Sequence
  derived and/or modified CDS sequence (opt4) from MERS-CoV__ALJ54456__S1
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccuga

SEQ ID NO: 1997 - RNA, 2244 nt, Artificial Sequence
  derived and/or modified CDS sequence (opt4) from MERS-CoV__ALJ54461__S1
augauccacagcguguuccugcugauguuccugcugacccccaccgagagcuacguggacgugggccccgacagcgugaagcccgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugaccagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagaccagcgugggcugcgugcugggccuggugaacagcagccuguucguggaggacugcaagcugccccugggccagagccugugcgcccugcccgacacccccagcacccugacccccuga

SEQ ID NO: 1998 - RNA, 2244 nt, Artificial Sequence
  derived and/or modified CDS sequence (opt4) from MERS-CoV__ALJ54468__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 1999 - RNA, 2244 nt, Artificial Sequence
  derived and/or modified CDS sequence (opt4) from MERS-CoV__ALJ54471__S1
augauccacagcguguaccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2000 - RNA, 2244 nt, Artificial Sequence
  derived and/or modified CDS sequence (opt4) from MERS-CoV__ALJ54472__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugcugcagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccuggcccccuga

SEQ ID NO: 2001 - RNA, 2244 nt, Artificial Sequence
  derived and/or modified CDS sequence (opt4) from MERS-CoV__ALJ54474__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccagcaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2002 - RNA, 2244 nt, Artificial Sequence
  derived and/or modified CDS sequence (opt4) from MERS-CoV__ALJ54483__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucuuccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2003 - RNA, 2244 nt, Artificial Sequence
  derived and/or modified CDS sequence (opt4) from MERS-CoV__ALJ54486__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagauacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggugagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2004 - RNA, 2244 nt, Artificial Sequence
  derived and/or modified CDS sequence (opt4) from MERS-CoV__ALJ54488__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacaucuacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2005 - RNA, 2244 nt, Artificial Sequence
  derived and/or modified CDS sequence (opt4) from MERS-CoV__ALJ54490__S1
augauccacagcguguuccugcugauguuccugcugacccccaccgagagcuacguggacgugggccccgacagcgugaagagcgccugcaucgccguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugaagcccuga

SEQ ID NO: 2006 - RNA, 2244 nt, Artificial Sequence
  derived and/or modified CDS sequence (opt4) from MERS-CoV__ALJ54495__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggugagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2007 - RNA, 2244 nt, Artificial Sequence
  derived and/or modified CDS sequence (opt4) from MERS-CoV__ALJ54496__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcccagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2008 - RNA, 2244 nt, Artificial Sequence
  derived and/or modified CDS sequence (opt4) from MERS-CoV__ALJ54500__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagccugcugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2009 - RNA, 2244 nt, Artificial Sequence
  derived and/or modified CDS sequence (opt4) from MERS-CoV__ALJ54501__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcacccugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2010 - RNA, 2244 nt, Artificial Sequence; identical to SEQ ID NO: 1953
  derived and/or modified CDS sequence (opt4) from MERS-CoV__ALJ54502__S1

SEQ ID NO: 2011 - RNA, 2244 nt, Artificial Sequence
  derived and/or modified CDS sequence (opt4) from MERS-CoV__ALJ54512__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgcccaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2012 - RNA, 2244 nt, Artificial Sequence
  derived and/or modified CDS sequence (opt4) from MERS-CoV__ALJ54517__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcaacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2013 - RNA, 2244 nt, Artificial Sequence; identical to SEQ ID NO: 2007
  derived and/or modified CDS sequence (opt4) from MERS-CoV__ALJ54518__S1

SEQ ID NO: 2014 - RNA, 2244 nt, Artificial Sequence
  derived and/or modified CDS sequence (opt4) from MERS-CoV__ALW82691__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugagaagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2015 - RNA, 2244 nt, Artificial Sequence
  derived and/or modified CDS sequence (opt4) from MERS-CoV__ALW82742__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccauccagaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2016 - RNA, 2244 nt, Artificial Sequence; identical to SEQ ID NO: 2001
  derived and/or modified CDS sequence (opt4) from MERS-CoV__ALW82753__S1

SEQ ID NO: 2017 - RNA, 2244 nt, Artificial Sequence
  derived and/or modified CDS sequence (opt4) from MERS-CoV__ALX27228__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccguguggaaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugagcugcgugcugggccuggugaacagcagccuguucguggaggacugcaagcugccccugggccagagccugugcgcccugcccgacacccccagcacccugacccccuga

SEQ ID NO: 2018 - RNA, 2244 nt, Artificial Sequence; identical to SEQ ID NO: 1959
  derived and/or modified CDS sequence (opt4) from MERS-CoV__ALX27232__S1

SEQ ID NO: 2019 - RNA, 2244 nt, Artificial Sequence
  derived and/or modified CDS sequence (opt4) from MERS-CoV__AMQ48993__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaucguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2020 - RNA, 2244 nt, Artificial Sequence
  derived and/or modified CDS sequence (opt4) from MERS-CoV__AMW90844__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccuuccaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2021 - RNA, 2244 nt, Artificial Sequence; identical to SEQ ID NO: 1973
  derived and/or modified CDS sequence (opt4) from MERS-CoV__AMW90852__S1

SEQ ID NO: 2022 - RNA, 2244 nt, Artificial Sequence
  derived and/or modified CDS sequence (opt4) from MERS-CoV__AMW90853__S1
augauccacagcguguuccugcugauguuccugcugacccccaccgagagcuacguggacgugggcagcgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggcuacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaacuucaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2023 - RNA, 2244 nt, Artificial Sequence
  derived and/or modified CDS sequence (opt4) from MERS-CoV__ANC28656__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2024 - RNA, 2244 nt, Artificial Sequence
  derived and/or modified CDS sequence (opt4) from MERS-CoV__ANC28678__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucugcagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacggcagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2025 - RNA, 2244 nt, Artificial Sequence
  derived and/or modified CDS sequence (opt4) from MERS-CoV__AHL18090__S1
augauccacagcguguuccugcugauguuccugcugacccccaccgagagcuacguggacgugggccuggacagcgccaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucagcagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaagaagaccaagacccacgccacccuguucggcagcguggccugcgagcacaucagcagcaccaugagccaguacagcagaagcaccagaagcacccugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2026 - RNA, 2244 nt, Artificial Sequence
  derived and/or modified CDS sequence (opt4) from MERS-CoV__AHX00731__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugggcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2027 - RNA, 2244 nt, Artificial Sequence
  derived and/or modified CDS sequence (opt4) from MERS-CoV__AHX71946__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagccacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2028 - RNA, 2244 nt, Artificial Sequence
  derived and/or modified CDS sequence (opt4) from MERS-CoV__AHY22545__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaacagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2029 - RNA, 2244 nt, Artificial Sequence
  derived and/or modified CDS sequence (opt4) from MERS-CoV__AHY22555__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaacuacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccagcuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacagcaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2030 - RNA, 2244 nt, Artificial Sequence
  derived and/or modified CDS sequence (opt4) from MERS-CoV__AHY22565__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaucaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccagcuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2031 - RNA, 2244 nt, Artificial Sequence
  derived and/or modified CDS sequence (opt4) from MERS-CoV__AJG44069__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccccagaaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccuga

SEQ ID NO: 2032 - RNA, 2244 nt, Artificial Sequence
  derived and/or modified CDS sequence (opt4) from MERS-CoV__AJG44080__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcaucaagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcccccugacccccuga

SEQ ID NO: 2033 - RNA, 2244 nt, Artificial Sequence
  derived and/or modified CDS sequence (opt4) from MERS-CoV__AJG44102__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugagccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaucagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2034 - RNA, 2244 nt, Artificial Sequence
  derived and/or modified CDS sequence (opt4) from MERS-CoV__AJG44124__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccauguuccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2035 - RNA, 2244 nt, Artificial Sequence
  derived and/or modified CDS sequence (opt4) from MERS-CoV__ALL26396__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccugagcguggaggacugcaagcugccccugggccagagccugugcgcccugcccgacacccccagcacccugacccccuga

SEQ ID NO: 2036 - RNA, 2244 nt, Artificial Sequence
  derived and/or modified CDS sequence (opt4) from MERS-CoV__ALS20350__S1
augauccacagcguguuccugcugauguuccugcugacccccaccgagagcuacguggacgugggccccgacagcgccaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaacuacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugaccgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2037 - RNA, 2244 nt, Artificial Sequence; identical to SEQ ID NO: 1953
  derived and/or modified CDS sequence (opt4) from MERS-CoV__ALT66880__S1

SEQ ID NO: 2038 - RNA, 2244 nt, Artificial Sequence
  derived and/or modified CDS sequence (opt4) from MERS-CoV__ALA49341__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccugcagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaucugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2039 - RNA, 2244 nt, Artificial Sequence
  derived and/or modified CDS sequence (opt4) from MERS-CoV__ALA49352__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuacuacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2040 - RNA, 2244 nt, Artificial Sequence
  derived and/or modified CDS sequence (opt4) from MERS-CoV__ALA49363__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccaccuuccccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2041 - RNA, 2244 nt, Artificial Sequence; identical to SEQ ID NO: 1973
  derived and/or modified CDS sequence (opt4) from MERS-CoV__ALA49374__S1

SEQ ID NO: 2042 - RNA, 2244 nt, Artificial Sequence
  derived and/or modified CDS sequence (opt4) from MERS-CoV__ALA49396__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcagcagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2043 - RNA, 2244 nt, Artificial Sequence
  derived and/or modified CDS sequence (opt4) from MERS-CoV__ALA49451__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaaccugccccugggccagagccugugcgcccugcccgacacccccagcacccugacccccuga

SEQ ID NO: 2044 - RNA, 2244 nt, Artificial Sequence
  derived and/or modified CDS sequence (opt4) from MERS-CoV__ALA49473__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccaccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2045 - RNA, 2244 nt, Artificial Sequence; identical to SEQ ID NO: 1953
  derived and/or modified CDS sequence (opt4) from MERS-CoV__ALA49583__S1

SEQ ID NO: 2046 - RNA, 2244 nt, Artificial Sequence
  derived and/or modified CDS sequence (opt4) from MERS-CoV__ALA49649__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccacccccaagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccauccccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccacaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2047 - RNA, 2244 nt, Artificial Sequence
  derived and/or modified CDS sequence (opt4) from MERS-CoV__ALA49660__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaaguucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2048 - RNA, 2244 nt, Artificial Sequence
  derived and/or modified CDS sequence (opt4) from MERS-CoV__ALA49671__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccaacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2049 - RNA, 2244 nt, Artificial Sequence; identical to SEQ ID NO: 1953
  derived and/or modified CDS sequence (opt4) from MERS-CoV__ALA49682__S1

SEQ ID NO: 2050 - RNA, 2244 nt, Artificial Sequence
  derived and/or modified CDS sequence (opt4) from MERS-CoV__ALA49803__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacagauacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccagcaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcgccggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2051 - RNA, 2244 nt, Artificial Sequence; identical to SEQ ID NO: 2042
  derived and/or modified CDS sequence (opt4) from MERS-CoV__ALA49836__S1

SEQ ID NO: 2052 - RNA, 2244 nt, Artificial Sequence; identical to SEQ ID NO: 1953
  derived and/or modified CDS sequence (opt4) from MERS-CoV__ALA49957__S1

SEQ ID NO: 2053 - RNA, 2244 nt, Artificial Sequence
  derived and/or modified CDS sequence (opt4) from MERS-CoV__ALA50067__S1
augauccacagcguguuccugcugauguuccugcugacccccaccgagagcuacguggacgugggccccgacagcgugaagagcgccugcaucgagguggacauccagcagaccuucuucgacaagaccuggcccagacccaucgacgugagcaaggccgacggcaucaucuacccccagggcagaaccuacagcaacaucaccaucaccuaccagggccuguuccccuaccagggcgaccacggcgacauguacguguacagcgccggccacgccaccggcaccaccccccagaagcuguucguggccaacuacagccaggacgugaagcaguucgccaacggcuucguggugagaaucggcgccgccgccaacagcaccggcaccgugaucaucagccccagcaccagcgccaccaucagaaagaucuaccccgccuucaugcugggcagcagcgugggcaacuucagcgacggcaagaugggcagauucuucaaccacacccuggugcugcugcccgacggcugcggcacccugcugagagccuucuacugcauccuggagcccagaagcggcaaccacugccccgccggcaacagcuacaccagcuucgccaccuaccacacccccgccaccgacugcagcgacggcaacuacaacagaaacgccagccugaacagcuucaaggaguacuucaaccugagaaacugcaccuucauguacaccuacaacaucaccgaggacgagauccuggagugguucggcaucacccagaccgcccagggcgugcaccuguucagcagcagauacguggaccuguacggcggcaacauguuccaguucgccacccugcccguguacgacaccaucaaguacuacagcaucaucccccacagcaucagaagcauccagagcgacagaaaggccugggccgccuucuacguguacaagcugcagccccugaccuuccugcuggacuucagcguggacggcuacaucagaagagccaucgacugcggcuucaacgaccugagccagcugcacugcagcuacgagagcuucgacguggagagcggcguguacagcgugagcagcuucgaggccaagcccagcggcagcgugguggagcaggccgagggcguggagugcgacuucagcccccugcugagcggcacccccccccagguguacaacuucaagagacugguguucaccaacugcaacuacaaccugaccaagcugcugagccuguucagcgugaacgacuucaccugcagccagaucagccccgccgccaucgccagcaacugcuacagcagccugauccuggacuacuucagcuacccccugagcaugaagagcgaccugagcgugagcagcagcggccccaucagccaguucaacuacaagcagagcuucagcaaccccaccugccugauccuggccaccgugccccacaaccugaccaccaucaccaagccccugaaguacagcuacaucaacaagugcagcagacugcugagcgacgacagaaccgaggugccccagcuggugaacgccaaccaguacagccccugcgugagcaucgugcccagcaccgugugggaggacggcgacuacuacagaaagcagcugagcccccuggagggcggcggcuggcugguggccagcggcagcaccguggccaugaccgagcagcugcagaugggcuucggcaucaccgugcaguacggcaccgacaccaacagcgugugccccaagcuggaguucgccaacgacaccaagaucgccagccagcugggcaacugcguggaguacagccuguacggcgugagcggcagaggcguguuccagaacugcaccgccgugggcgugagacagcagagauucguguacgacgccuaccagaaccuggugggcuacuacagcgacgacggcaacuacuacugccugagagccugcgugagcgugcccgugagcgugaucuacgacaaggagaccaagacccacgccacccuguucggcagcguggccugcgagcacaucagcagcaccaugagccaguacagcagaagcaccagaagcaugcugaagagaagagacagcaccuacggcccccugcagacccccgugggcugcgugcugggccuggugaacagcagccuguucguggaggacugcaagcugccccugggccagagccugugcgcccugcccgacacccccagcacccugacccccuga

SEQ ID NO: 2054 - RNA, 2244 nt, Artificial Sequence
  derived and/or modified CDS sequence (opt5) from MERS-CoV__AFS88936__S1
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2055 - RNA, 2244 nt, Artificial Sequence
  derived and/or modified CDS sequence (opt5) from MERS-CoV__AFY13307__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagauuucuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccuga

SEQ ID NO: 2056 - RNA, 2244 nt, Artificial Sequence
  derived and/or modified CDS sequence (opt5) from MERS-CoV__AGH58717__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccguuacaaccccucaaaaacucuuuguggcuaauuauucccaggacgucaagcaguucgccaacggguuugugguucgcauuggagccgcugccaauucuacgggcaccgugaucauuagccccuccacaagcgcuaccaucagaaaaauuuacccugccuucaugcuggggucuuccgucgggaacuuuagcgauggaaagaugggccgguucuuuaaucauacacuugugcugcucccggacggguguggaacccugcugcgcgcguucuacugcauccucgagcccagaucuggcaacuauuguccugccggcaauuccuacacgagcuuugcuacauaucacacccccgccacagauugcucugacggaaacuacaaucggaacgcuucccugaauagcuucaaggaauauuucaaccuucgcaauuguaccuuuauguacaccuauaacauuacagaggaugaaauccuggagugguucggcaucacgcagaccgcccaaggcgugcaucucuuuuccucuagauacgucgaccuguacgggggaaauauguuccaguuugcgacacuuccuguuuaugacaccauuaaauacuauagcaucauuccccacuccauccugagcauucagucugaucggaaggccugggcugccuucuacguguauaaacuccagccgcugacauuucugcucgacuucuccguggauggcuacauccgcagagcuaucgacugcggguuuaacgaucugagccaacuucacuguucuuaugagagcuucgacgucgaauccggaguguacucuguuagcuccuuugaggccaagccuagcggcucuguggucgaacaggccgaggggguggagugcgauuucagcccccugcucuccggaaccccuccccagguuuacaacuuuaaacggcugguguucacgaauuguaacuauaaucuuacaaagcugcucucucuguucuccgucaacgacuuuaccugcagccaaauuucccccgcugcgaucgccucuaauuguuacagcucccugauucucgauuauuucucuuacccucugagcaugaaguccgaccuuagcgugucuuccgcuggcccgaucagccaguuuaacuauaaacagucuuucuccaauccuaccugccugauucucgccacagucccccauaaccugaccacaaucacgaagccccuuaaauacagcuauaucaauaagugcucucgccugcucagcgaugacagaaccgaagugccucagcugguuaacgccaaucaauacucccccugugugagcauugucccgucuacagugugggaggacggcgauuacuaucggaaacagcuguccccucucgaagggggaggcuggcugguugcuagcggguccaccguggccaugacagagcagcuucagaugggauuuggcaucaccguccaauacgggacggacaccaacucugugugccccaagcuggaguucgcgaaugauacaaaaauugcuagccagcucggcaacuguguggaauauucccuguacggaguuucuggccgcggggucuuucagaauugcaccgccgugggagugagacagcaacgguucgucuaugacgccuaccagaaccuggugggcuauuacagcgaugacgggaacuacuauugucuuagagcuugcguuuccgugccugucucugugaucuacgauaaggagacaaagacccacgccacgcucuuuggaagcguugcuugugaacauauuuccagcacaaugucucaguauucccgcagcacccggucuaugcugaaaagacgcgacuccacauacggcccccugcagaccccuguggggugcguccucggccuggugaauagcucucuuuucguugaggauuguaagcugccccucggacaaucccugugcgcccugccggacaccccuagcacacuuacgcccuga

SEQ ID NO: 2057 - RNA, 2244 nt, Artificial Sequence
  derived and/or modified CDS sequence (opt5) from MERS-CoV__AGN52936__S1
augauccacagcguguuccugcucauguuucugcuuacccccacagaguccuacgucgacguuggcccugauucuauuaagagcgccugcaucgaaguggacauucagcaaacguucuuugauaaaaccuggccgagacccaucgacguguccaaggcugaugggauuaucuauccucagggacggacauacucuaacaucaccauuacauaucagggccuguuccccuaccagggggaccauggagauauguaugucuacagcgccggccacgcgaccgggacaaccccucaaaaacucuuuguggcuaauuauucccaggacguuaagcaguucgccaacggauuugugguccgcaucggcgccgcugccaauucuacgggcaccgugauuaucagccccuccacaagcgcuaccauuagaaaaaucuacccugccuucaugcuggggucuuccguuggaaacuuuagcgauggcaagauggggcgguucuuuaaucauacacuugugcugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauccuggagugguucggcauuacgcagaccgcccaagggguccaccucuuuuccucuagauauguggaccuguacggaggcaauauguuccaguuugcgacacuuccuguguacgacaccaucaaauauuacagcauuaucccccacuccauucggagcauccagucugaucgcaaggccugggcugccuucuaugucuacaaacugcagccgcucacauuucugcuggacuucuccguugauggguauaucagacgggcuauugacugcggauuuaacgaucucagccaacugcauuguucuuacgagagcuucgacguggaauccggcguguauucugucagcuccuuugaggccaagccuagcgggucugugguugaacaggccgagggaguggagugcgauuucagcccccuucuguccggcaccccuccccaggucuacaacuuuaaacgccucguguucacgaauuguaacuacaaucugacaaaacuucugucucucuucuccguuaacgacuuuaccugcagccaaaucucccccgcugcgauugccucuaauuguuauagcucccugauccuggauuacuucucuuauccucucagcaugaaguccgaccugagcgugucuuccgcuggcccgauuagccaguuuaacuacaagcagucuuucuccaauccuaccugccuuauccuggccacagucccccacaaccucaccacaaucacgaagccccugaaauauagcuacauuaauaagugcucuagacuucugagcgaugaccggaccgaagugccucagcucgucaacgccaaucaauauucccccugugugagcaucguuccgucuacagugugggaggacggggauuacuaccgcaaacagcuguccccucuggaaggaggcggguggcucgucgcuagcggauccaccguggccaugacagagcagcugcagaugggcuuugggauuaccguucaauauggcacggacaccaacucugugugccccaaacuugaguucgcgaaugauacaaagaucgcuagccagcugggaaacugugucgaauacucccucuauggcgugucugggagaggaguguuucagaauugcaccgccguuggcguccggcagcaaagauucguguacgacgccuaucagaaccuggugggguacuauagcgaugacggaaacuacuacugucugcgcgcuugcgucuccgugccuguuucugugauuuaugauaaggagacaaagacccaugccacgcuuuuuggcagcgucgcuugugaacacaucuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcccugccggacaccccuagcacacugacgcccuga

SEQ ID NO: 2058 - RNA, 2244 nt, Artificial Sequence
  derived and/or modified CDS sequence (opt5) from MERS-CoV__AGN70951__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2059 - RNA, 2244 nt, Artificial Sequence
  derived and/or modified CDS sequence (opt5) from MERS-CoV__AGV08408__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcggggaucggaccgaagucccucagcucgugaacgccaaucaauauucccccuguguuagcauugugccgucuacagucugggaggacggagacuacuaccgcaaacagcuguccccucuggaaggcgggggauggcucguggcuagcggcuccaccguugccaugacagagcagcugcagaugggguuuggcaucaccgugcaauauggaacggauaccaacucugucugccccaaacuugaguucgcgaaugacacaaagauugcuagccagcugggcaacuguguggaauacucccucuauggggugucuggaagaggcguuuuucagaauugcaccgccgucggggugcggcagcaaagauucguguacgaugccuaucagaaccuggucggauacuauagcgacgauggcaacuacuacugucugcgcgcuugcguguccguuccugugucugucaucuaugacaaggagacaaagacccaugccacgcuuuuugggagcguggcuugugaacacauuuccagcacaaugucucaguacucccggagcaccagaucuaugcucaaacgccgggauuccacauauggcccccugcagaccccuguuggaugcgugcugggccucgucaauagcucucuguucguggaggacuguaaacuuccccuggggcaaucccucugcgcccugccggauaccccuagcacacugacgcccuga

SEQ ID NO: 2060 - RNA, 2244 nt, Artificial Sequence
  derived and/or modified CDS sequence (opt5) from MERS-CoV__AGV08455__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcuacggcaagauggggcgguucuuuaaucauacacuuguccugcucccggauggauguggcacccugcugcgcgcguucuauugcauccucgagcccagaucugggaaccacuguccugccggaaauuccuacacgagcuuugcuacauaucauacccccgccacagacugcucugauggcaacuacaaucggaacgcuucccugaauagcuucaaggaauauuucaaccuucgcaauuguaccuuuauguacaccuauaacauuacagaggacgaaauccuggagugguucggcaucacgcagaccgcccaaggggugcaccucuuuuccucuagauacguggaucuguacggaggcaauauguuccaguuugcgacacuuccugucuaugacaccauuaaauacuauagcaucauuccccacuccauccggagcauucagucugaccgcaaggccugggcugccuucuacguuuauaaacugcagccgcucacauuucugcuggauuucuccguggacggguacaucagacgggcuaucgauugcggauuuaacgaccucagccaacugcauuguucuuaugagagcuucgauguggaauccggcgucuacucugugagcuccuuugaggccaagccuagcgggucuguuguggaacaggccgagggagucgagugcgacuucagcccccuucuguccggcaccccuccccagguguacaacuuuaaacgccucguuuucacgaauuguaacuauaaucugacaaaacuucugucucucuucuccgugaacgauuuuaccugcagccaaauuucccccgcugcgaucgccucuaauuguuacagcucccugauucuggacuauuucucuuacccucucagcaugaaguccgaucugagcgucucuuccgcuggcccgaucagccaguuuaacuauaagcagucuuucuccaauccuaccugccuuauucuggccacagugccccacaaccucaccacaaucacgaagccccugaaauacagcuauaucaauaagugcucuagacuucugagcgacgaucggaccgaagucccucagcucgugaacgccaaucaauacucccccuguguuagcauugugccgucuacagucugggaggacggggacuacuaucgcaaacagcuguccccucuggaaggaggcggguggcucguggcuagcggauccaccguugccaugacagagcagcugcagaugggcuuugggaucaccgugcaauacggcacggauaccaacucugucugccccaaacuugaguucgcgaaugacacaaagauugcuagccagcugggaaacuguguggaauauucccucuacggcgugucugggagaggaguuuuucagaauugcaccgccgucggcgugcggcagcaaagauucguguaugaugccuaccagaaccuggucggguauuacagcgacgauggaaacuacuauugucugcgcgcuugcguguccguuccugugucugucaucuacgacaaggagacaaagacccaugccacgcuuuuuggcagcguggcuugugaacacauuuccagcacaaugucucaguauucccggagcaccagaucuaugcucaaacgccgggauuccacauacgggccccugcagaccccuguuggcugcgugcugggacucgucaauagcucucuguucguggaggacuguaaacuuccccugggccaaucccucugcgcccugccggauaccccuagcacacugacgcccuga

SEQ ID NO: 2061 - RNA, 2244 nt, Artificial Sequence; identical to SEQ ID NO: 2058
  derived and/or modified CDS sequence (opt5) from MERS-CoV__AGV08467__S1

SEQ ID NO: 2062 - RNA, 2244 nt, Artificial Sequence; identical to SEQ ID NO: 2058
  derived and/or modified CDS sequence (opt5) from MERS-CoV__AGV08492__S1

SEQ ID NO: 2063 - RNA, 2244 nt, Artificial Sequence
  derived and/or modified CDS sequence (opt5) from MERS-CoV__AGV08584__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagcuugggaggacggggauuacuaccgcaaacagcuguccccucuggaaggaggcggguggcucgucgccagcggauccaccguggcgaugacagagcagcugcagaugggcuuugggaucaccguucaauauggcacggacaccaacucugugugccccaaacuugaguucgcuaaugauacaaagauugccagccagcugggaaacugugucgaauacucccucuauggcgugucugggagaggaguguuucagaauugcaccgccguuggcguccggcagcaaagauucguguacgacgcuuaucagaaccuggugggguacuauagcgaugacggaaacuacuacugucugcgcgccugcgucuccgugccuguuucugugaucuaugauaaggagacaaagacccaugcuacgcuuuuuggcagcgucgccugugaacacauuuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcgcugccggacaccccuagcacacugacgcccuga

SEQ ID NO: 2064 - RNA, 2244 nt, Artificial Sequence
  derived and/or modified CDS sequence (opt5) from MERS-CoV__AHB33326__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccuacucuacgggcaccguuaucauuagccccuccacaagcgcuaccaucagaaaaauuuacccugccuucaugcuggggucuuccgugggaaauuuuagcgauggcaagauggggcgguucuuuaaccauacacuuguccugcucccggacggauguggcacccugcugcgcgcguucuauugcauccucgagcccagaucugggaaucacuguccugccggaaacuccuacacgagcuuugcuacauaucauacccccgccacagauugcucugacggcaauuacaaccggaaugcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaauucugucugccccaaacuugaguucgcgaacgauacaaagauugcuagccagcugggaaauuguguggaauauucccucuacggcgugucugggagaggaguuuuucagaacugcaccgccgucggcgugcggcagcaaagauucguguaugacgccuaccagaaucuggucggguauuacagcgaugacggaaacuacuauugucugcgcgcuugcguguccguuccugugucugucaucuacgauaaggagacaaagacccaugccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaacagcucucuguucguggaggauuguaaacuuccccugggccaaucccucugcgcccugccggacaccccuagcacacugacgcccuga

SEQ ID NO: 2065 - RNA, 2244 nt, Artificial Sequence
  derived and/or modified CDS sequence (opt5) from MERS-CoV__AHC74088__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuuugcuggcccgaucucccaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccuga

SEQ ID NO: 2066 - RNA, 2244 nt, Artificial Sequence
  derived and/or modified CDS sequence (opt5) from MERS-CoV__AHI48528__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaagcuccugucucucuucuccgugaacgacuuuaccugcagccaaauuucucccccugcuaucgcguccaauuguuauagcucccugauucuggauuacuucucuuauccgcucagcaugaaguccgaccugagcgucucuuccgccggccccaucagccaguuuaacuacaaacagucuuucuccaauccuaccugccuuauucuggugacagucccccacaaccucaccacaaucacgaagccucugaaauauagcuacaucaauaagugcucuagacuucugagcgaugaccggaccgaagugccccagcucguuaacgcuaaucaauauuccccgugugugagcauugucccuucuacagugugggaggacggggauuacuaccgcaaacagcugagcccccuggaaggaggcggguggcucguugccuccggauccaccguggccaugacagagcagcugcagaugggcuuugggaucaccguccaauauggcacggacaccaacucugugugcccuaaacuugaguucgcuaaugauacaaagauugccagccagcugggaaacuguguggaauacucccucuauggcguuucugggagaggagucuuucagaauugcaccgcggugggcgugcggcagcaaagauucgucuacgacgcuuaucagaaccuggugggguacuauagcgaugacggaaacuacuacugucugcgcgccugcguuuccgugcccgucucugugaucuaugauaaggagacaaagacccaugccacgcuuuuuggcagcguugcuugugaacacauuuccagcacaaugucucaguacucccggagcaccagaucuaugcucaaacgccgggacuccacauaugggccucugcagacccccgugggcugcguccugggacucgugaauagcucucuguucguugaggauuguaaacuuccgcugggccaaucccucugcgcccugccugacacccccagcacacugacgcccuga

SEQ ID NO: 2067 - RNA, 2244 nt, Artificial Sequence; identical to SEQ ID NO: 2058
  derived and/or modified CDS sequence (opt5) from MERS-CoV__AHI48550__S1

SEQ ID NO: 2068 - RNA, 2244 nt, Artificial Sequence
  derived and/or modified CDS sequence (opt5) from MERS-CoV__AHI48583__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguucaaggcugaugggaucauuuauccucagggacggacauacuccaacaucaccaucacauaucagggccuguuucccuaccagggggaccauggagauauguauguguacucugccggccacgcgaccgggacaaccccucaaaaacucuucguugcuaauuauagccaggacgugaagcaguuugccaacggauucgucgugcgcauuggcgccgcugccaauuccacgggcaccguuaucauuucucccagcacauccgcuaccaucagaaaaauuuacccugccuuuaugcuggggagcucugugggaaacuucuccgauggcaagauggggcgguuuuucaaucauacacuuguccugcucccggacggauguggcacccugcugcgcgcguuuuacugcauccucgagcccagaagcgggaaccacuguccugccggaaauucuuauacguccuucgcuacauaccauacccccgccacagauugcagcgacggcaacuauaaucggaacgcuucucuuaauuccuucaaggaauacuuuaaccuucgcaauuguaccuucauguauaccuacaacauuacagaggaugaaauccuggagugguuuggcaucacgcagaccgcccaaggggugcaccucuucagcuccagauauguggaccuguacggaggcaauauguuucaguucgcgacacuuccugucuacgacaccauuaaauauuacucuaucauuccccacagcauccgguccauucagagcgaucgcaaggccugggcugccuuuuauguuuacaaacugcagccgcucacauuccugcuggacuuuucuguggauggguauaucagacgggcuaucgacugcggauucaacgaucucucccaacugcauuguagcuacgagucuuuugacguggaaagcggcgucuauuccgugucuagcuucgaggccaagccuuccgggagcguuguggaacaggccgagggagucgagugcgauuuuucuccccuucuguccggcaccccuccccagguguacaacuucaaacgccucguuuucacgaauuguaacuacaaucugacaaagcugcugagccucuuuucugugaacgacuuuaccugcucccaaauuagccccgcugcgaucgccuccaauuguuauucuagccugauucuggauuacuucuccuauccucucucuaugaaaagcgaccuguccgucagcucugcuggcccgaucucccaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccuga

SEQ ID NO: 2069 - RNA, 2244 nt, Artificial Sequence; identical to SEQ ID NO: 2058
  derived and/or modified CDS sequence (opt5) from MERS-CoV__AHI48605__S1

SEQ ID NO: 2070 - RNA, 2244 nt, Artificial Sequence; identical to SEQ ID NO: 2056
  derived and/or modified CDS sequence (opt5) from MERS-CoV__AHY21469__S1

SEQ ID NO: 2071 - RNA, 2244 nt, Artificial Sequence
  derived and/or modified CDS sequence (opt5) from MERS-CoV__AHZ64057__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuucuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccuga

SEQ ID NO: 2072 - RNA, 2244 nt, Artificial Sequence; identical to SEQ ID NO: 2058
  derived and/or modified CDS sequence (opt5) from MERS-CoV__AID50418__S1

SEQ ID NO: 2073 - RNA, 2244 nt, Artificial Sequence; identical to SEQ ID NO: 2058
  derived and/or modified CDS sequence (opt5) from MERS-CoV__AID55068__S1

SEQ ID NO: 2074 - RNA, 2244 nt, Artificial Sequence
  derived and/or modified CDS sequence (opt5) from MERS-CoV__AID55073__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccuga

SEQ ID NO: 2075 - RNA, 2244 nt, Artificial Sequence
  derived and/or modified CDS sequence (opt5) from MERS-CoV__AIY60528__S1
augauccacagcguguuccugcucauguuucugcuuacccccacagaguccuacgucgacguuggcccugauucuuucaagagcgccugcauugaaguggacauccagcaaacguuuuucgauaaaaccuggccgagacccauugacguguccaaggcugaugggaucauuuauccucagggacggacauacucuaacaucaccaucacauaucagggccuguuucccuaccagggggaccauggagauauguaugucuacagcgccggccacgcgaccgggacaaccccucaaaaacucuucguggcuaauuauucccagaacguuaagcaguuugccaauggauucgugguccgcauuggcgccgcugccaacucuacgggcaccgugaucauuagccccuccacaagcgcuaccaucagaaaaauuuacccugccuuuaugcuggggucuuccguuggaaauuucagcgacggcaagauggggcgguuuuucaaccauacacuugugcugcucccggauggauguggcacccugcugcgcgcguuuuacugcauccucgagcccagaucugggaaucacuguccugccggaaacuccuauacgagcuucgcuacauaccauacccccgccacagacugcucugauggcaauuauaaccggaaugcuucccugaacagcuucaaggaauacuuuaaucuucgcaacuguaccuucauguauaccuacaauauuacagaggacgaaauccuggagugguuuggcaucacgcagaccgcccaagggguccaccucuucuccucuagauauguggaucuguacggaggcaacauguuucaguucgcgacacuuccuguguacgacaccauuaaauauuacagcaucauuccccacuccauccggagcauucagucugaccgcaaggccugggcugccuuuuaugucuacaaacugcagccgcucacauuccugcuggauuuuuccguugacggguauaucagacgggcuaucgauugcggauucaacgaccucagccaacugcauuguucuuacgagagcuuugauguggaauccggcguguauucugucagcuccuucgaggccaagccuagcgggucugugguugaacaggccgagggaguggagugcgacuuuagcccccuucuguccggcaccccuccccaggucuacaauuucaaacgccucguguucacgaacuguaauuacaaccugacaaaacuucugucucucuuuuccguuaaugauuuuaccugcagccaaauuucccccgcugcgaucgccucuaacuguuauagcucccugauucuggacuacuucucuuauccucucagcaugaaguccgaucugagcgugucuuccgcuggcccgaucagccaguucaauuacaagcagucuuuuuccaacccuaccugccuuauucuggccacagucccccacaaucucaccacaaucacgaagccccugaaauauagcuacaucaacaagugcucuagacuucugagcgacgaucggaccgaagugccucagcucgucaaugccaaccaauauucccccugugugagcauuguuccgucuacagugugggaggacggggacuacuaccgcaaacagcuguccccucuggaaggaggcggguggcucgucgcuagcggauccaccguggccaugacagagcagcugcagaugggcuucgggaucaccguucaauauggcacggauaccaauucugugugccccaaacuugaauuugcgaacgacacaaagauugcuagccagcugggaaauugugucgaguacucccucuauggcgugucugggagaggaguguuccagaacugcaccgccguuggcguccggcagcaaagauuuguguacgaugccuaucagaaccuggugggguacuauagcgacgauggaaauuacuacugucugcgcgcuugcgucuccgugccuguuucugugaucuaugacaaggagacaaagacccaugccacgcuuuucggcagcgucgcuugugaacacauuuccagcacaaugucucaguacucccggagcaccagaucuaugcucaaacgccgggauuccacauaugggccccugcagaccccugugggcugcguucugggacucgugaacagcucucuguuugucgaggacuguaaacuuccccugggccaaucccucugcgcccugccggauaccccuagcacacugacgcccuga

SEQ ID NO: 2076 - RNA, 2244 nt, Artificial Sequence
  derived and/or modified CDS sequence (opt5) from MERS-CoV__AIY60558__S1
augauccacagcguguuccugcucauguuucugcuuacccccacagaguccuacgucgacguuggcccugauucuuucaagagcgccugcauugaaguggacauccagcaaacguuuuucgauaaaaccuggccgagacccauugacguguccaaggcugaugggaucauuuauccucagggacggacauacucuaacaucaccaucacauaucagggccuguuucccuaccagggggaccauggagauauguaugucuacagcgccggccacgcgaccgggacaaccccucaaaaacucuucguggcuaauuauucccaggacguuaagcaguuugccaacggauucgugguccgcauuggcgccgcugccaauucuacgggcaccgugaucauuagccccuccacaagcgcuaccaucagaaaaauuuacccugccuuuaugcuggggucuuccguuggaaacuucagcgauggcaagauggggcgguuuuucaaucauacacuugugcugcucccggacggauguggcacccugcugcgcgcguuuuacugcauccucgagcccagaucugggaaccacuguccugccggaaauuccuauacgagcuucgcuacauaccauacccccgccacagauugcucugacggcaacuauaaucggaacgcuucccugaauagcuucaaggaauacuuuaaccuucgcaauuguaccuucauguauaccuacaacauuacagaggaugaaauccuggagugguuuggcaucacgcagaccgcccaagggguccaccucuucuccucuagauauguggaccuguacggaggcaauauguuucaguucgcgacacuuccuguguacgacaccauuaaauauuacagcaucauuccccacuccauccggagcauucagucugaucgcaaggccugggcugccuuuuaugucuacaaacugcagccgcucacauuccugcuggacuuuuccguugauggguauaucagacgggcuaucgacugcggauucaacgaucucagccaacugcauuguucuuacgagagcuuugacguggaauccggcguguauucugucagcuccuucgaggccaagccuagcgggucugugguugaacaggccgagggaguggagugcgauuuuagcccccuucuguccggcaccccuccccaggucuacaacuucaaacgccucguguucacgaauuguaacuacaaucugacaaaacuucugucucucuuuuccguuaacgacuuuaccugcagccaaauuucccccgcugcgaucgccucuaauuguuauagcucccugauucuggauuacuucucuuauccucucagcaugaaguccgaccugagcgugucuuccgcuggcccgaucagccaguucaacuacaagcagucuuuuuccaauccuaccugccuuauucuggccacagucccccacaaccucaccacaaucacgaagccccugaaauauagcuacaucaauaagugcucuagacuucugagcgaugaccggaccgaagugccucagcucgucaacgccaaucaauauucccccugugugagcauuguuccgucuacagugugggaggacggggauuacuaccgcaaacagcuguccccucuggaaggaggcggguggcucgucgcuagcggauccaccguggccaugacagagcagcugcagaugggcuucgggaucaccguucaauauggcacggacaccaacucugugugccccaaacuugaauuugcgaaugauacaaagauugcuagccagcugggaaacugugucgaguacucccucuauggcgugucugggagaggaguguuccagaauugcaccgccguuggcguccggcagcaaagauuuguguacgacgccuaucagaaccuggugggguacuauagcgaugacggaaacuacuacugucugcgcgcuugcgucuccgugccuguuucugugaucuaugauaaggagacaaagacccaugccacgcuuuucggcagcgucgcuugugaacacauuuccagcacaaugucucaguacucccggagcaccagaucuaugcucaaacgccgggacuccacauaugggccccugcagaccccugugggcugcguucugggacucgugaauagcucucuguuugucgaggauuguaaacuuccccugggccaaucccucugcgcccugccggacaccccuagcacacugacgcccuga

SEQ ID NO: 2077 - RNA, 2244 nt, Artificial Sequence; identical to SEQ ID NO: 2058
  derived and/or modified CDS sequence (opt5) from MERS-CoV__AIZ74450__S1

SEQ ID NO: 2078 - RNA, 2244 nt, Artificial Sequence
  derived and/or modified CDS sequence (opt5) from MERS-CoV__AJD81440__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuaaccccagcacauccgcuaccaucagaaaaauuuacccugccuucaugcuggggagcucugugggaaauuuuuccgauggcaagauggggcgguucuuuaaccauacacuuguccugcucccggacggauguggcacccugcugcgcgcguucuacugcauccucgagcccagaagcgggaaucacuguccugccggaaacucuuauacguccuuugcuacauaccauacccccgccacagauugcagcgacggcaauuauaaccggaaugcuucucugaacuccuucaaggaauacuucaaucuucgcaacuguaccuuuauguauaccuacaauauuacagaggaugaaauccuggagugguucggcaucacgcagaccgcccaaggggugcaccucuuuagcuccagauauguggaccuguacggaggcaacauguuccaguuugcgacacuuccugucuacgacaccauuaaauauuacucuaucauuccccacagcauccgguccauucagagcgaucgcaaggccugggcugccuucuauguuuacaaacugcagccgcucacauuucugcuggacuucucuguggauggguauaucagacgggcuaucgacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaauuuuaaacgccucguuuucacgaacuguaauuacaaccugacaaaacuucugagccucuucucugugaaugacuuuaccugcucccaaauuagccccgcugcgaucgccuccaacuguuauucuagccugauucuggauuacuucuccuauccucucucuaugaaaagcgaccuguccgucagcucugcuggcccgaucucccaguuuaauuacaagcagagcuucucuaacccuaccugccuuauucuggccacagugccccacaaucucaccacaaucacgaagccccugaaguauuccuacaucaacaagugcagcagacuucugucugaugaccggaccgaagucccucagcucgugaaugccaaccaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuuugggaucaccgugcaauauggcacggacaccaauuccgucugccccaaacuugaguucgcgaacgauacaaagauugcuucucagcugggaaauuguguggaauacagccucuauggcguguccgggagaggaguuuuucagaacugcaccgccgucggcgugcggcagcaaagauucguguacgacgccuaucagaaccuggucggguacuauucugaugacggaaauuacuacugucugcgcgcuugcgugagcguuccuguguccgucaucuaugauaaggagacaaagacccaugccacgcuuuuuggcucuguggcuugugaacacauuagcuccacaaugagccaguacucucgguccaccagaagcaugcucaaacgccgggacucuacauaugggccccugcagaccccuguuggcugcgugcugggacucgucaacuccagccuguucguggaggauuguaaacuuccccugggccaaucucucugcgcccugccggacaccccuuccacacugacgcccuga

SEQ ID NO: 2079 - RNA, 2244 nt, Artificial Sequence
  derived and/or modified CDS sequence (opt5) from MERS-CoV__AKI29284__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaauuugcgaaugauacaaagauugcuagccagcugggaaacuguguggaguacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2080 - RNA, 2244 nt, Artificial Sequence
  derived and/or modified CDS sequence (opt5) from MERS-CoV__AKL59401__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagagcuaccauccggaaaauuuacccugccuucaugcuggggagcucugugggaaacuuuuccgauggcaagauggggcgcuucuuuaaucauacacuuguccugcucccggacggauguggcacccugcugagagcguucuacugcauccucgagccccggagcgggaaccacuguccugccggaaauucuuauacguccuuugcuacauaccauacccccgccacagauugcagcgacggcaacuauaaucgcaacgcuucucuuaauuccuucaaggaauacuucaaccuuagaaauuguaccuuuauguauaccuacaacauuacagaggaugaaauccuggagugguucggcaucacgcagaccgcccaaggggugcaccucuuuagcucccgguauguggaccuguacggaggcaauauguuccaguuugcgacacuuccugucuacgacaccauuaaauauuacucuaucauuccccacagcauccgcuccauucagagcgauagaaaggccugggcugccuucuauguuuacaaacugcagccgcucacauuucugcuggacuucucuguggauggguauauccggcgcgcuaucgacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaacuuuaaaagacucguuuucacgaauuguaacuacaaucugacaaagcugcugagccucuucucugugaacgacuuuaccugcucccaaauuagccccgcugcgaucgccuccaauuguuauucuagccugauucuggauuacuucuccuauccucucucuaugaaaagcgaccuguccgucagcucugcuggcccgaucucccaguuuaacuacaagcagagcuucucuaauccuaccugccuuauucuggccacagugccccacaaccucaccacaaucacgaagccccugaaauauuccuacaucaauaagugcagccggcuucugucugaugaccgcaccgaagucccucagcucgugaacgccaaucaauauagccccuguguuuccauucugccgagcacagugugggaggacggggauuacuacagaaaacagcugucuccucucgaaggaggcggguggcuggucgcuuccggaagcaccguggccaugacagagcagcuucagaugggcuuugggaucaccguucaauauggcacggacaccaacuccgugugccccaagcuggaguucgcgaaugauacaaaaauugcuucucagcucggaaacugugucgaauacagccuguauggcguguccgggcggggaguguuucagaauugcaccgccguuggcgucagacagcaacgcuucguguacgacgccuaucagaaccuggugggguacuauucugaugacggaaacuacuacugucuucgggcuugcgucagcgugccuguuuccgugaucuaugauaaggagacaaagacccaugccacgcucuuuggcucugucgcuugugaacacauuagcuccacaaugagccaguacucuagauccacccgcagcaugcugaaacggagagacucuacauaugggccccugcagaccccugugggcugcguucucggacuggucaauuccagccuuuucguggaggauuguaagcugccccucggccaaucucugugcgcccugccggacaccccuuccacacuuacgcccuga

SEQ ID NO: 2081 - RNA, 2244 nt, Artificial Sequence
  derived and/or modified CDS sequence (opt5) from MERS-CoV__AKM76229__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaagcuccugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaaacagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcccccugacacccuga

SEQ ID NO: 2082 - RNA, 2244 nt, Artificial Sequence
  derived and/or modified CDS sequence (opt5) from MERS-CoV__AKM76239__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaacucccucagcuggucaacgccaaucaauauucccccugugugagcauuguuccgucuacagugugggaggacggggauuacuaccgcaaacagcuguccccucucgaaggaggcggguggcuggucgcuagcggauccaccguggccaugacagagcagcuucagaugggcuuugggaucaccguucaauauggcacggacaccaacucugugugccccaagcuggaguucgcgaaugauacaaaaauugcuagccagcucggaaacugugucgaauacucccuguauggcgugucugggagaggaguguuucagaauugcaccgccguuggcguccggcagcaaagauucguguacgacgccuaucagaaccuggugggguacuauagcgaugacggaaacuacuacugucuucgcgcuugcgucuccgugccuguuucugugaucuaugauaaggagacaaagacccaugccacgcucuuuggcagcgucgcuugugaacacauuuccagcacaaugucucaguacucccggagcaccagaucuaugcugaaacgccgggacuccacauaugggccccugcagaccccugugggcugcguucucggacuggugaauagcucucuuuucgucgaggauuguaagcugccccucggccaaucccugugcgcccugccggacaccccuagcacacuuacgcccuga

SEQ ID NO: 2083 - RNA, 2244 nt, Artificial Sequence
  derived and/or modified CDS sequence (opt5) from MERS-CoV__AKN11072__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcacagugccgucuaccgucugggaggacggggauuacuaccgcaaacagcuguccccucuggaaggaggcggguggcucguggcuagcggauccacaguugccaugaccgagcagcugcagaugggcuuugggauuacggugcaauauggcaccgacacaaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacgcaugccacacuuuuuggcagcguggcuugugaacacaucuccagcaccaugucucaguacucccggagcacaagaucuaugcucaaacgccgggacuccaccuaugggccccugcagaccccuguuggcugcgugcugggacucgucaauagcucucuguucguggaggauuguaaacuuccccugggccaaucccucugcgcccugccggacacaccuagcacgcugacccccuga

SEQ ID NO: 2084 - RNA, 2244 nt, Artificial Sequence
  derived and/or modified CDS sequence (opt5) from MERS-CoV__AKN11074__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcacagugccgucuaccgucugggaggacggggauuacuaccgcaaacagcuguccccucuggaaggaggcggguggcucguggcuagcggauccacaguugccaugaccgagcagcugcagaugggcuuugggauuacggugcaauauggcaccgacacaaacucugucugccccaaacuugaguucgcgaaugauaccaagaucgcuagccagcugggaaacuguguggaauacucccucuauggcgugucugggagaggaguuuuucagaauugcacagccgucggcgugcggcagcaacauuucguguacgacgccuaucagaaccuggucggguacuauagcgaugacggaaacuacuacugucugagagcuugcguguccguuccugugucugucauuuaugauaaggagaccaagacgcacgccacacuuuuuggcagcguggcuugugaacacaucuccagcaccaugucucaguacucccgcagcacacggucuaugcucaaaagacgcgacuccaccuaugggccccugcagaccccuguuggcugcgugcugggacucgucaauagcucucuguucguggaggauuguaaacuuccccugggccaaucccucugcgcccugccggacacaccuagcacgcugacacccuga

SEQ ID NO: 2085 - RNA, 2244 nt, Artificial Sequence
  derived and/or modified CDS sequence (opt5) from MERS-CoV__AKN24803__S1
auggugcacagcgucuuccugcucauguuucugcuuacccccacagaguccuacguugacgugggcccugauucugugaaguccgccugcaucgaagucgacauucagcaaacguucuuugauaaaaccuggccgagacccaucgacguguccaaggcugaugggauuaucuauccucagggacggacauacucuaacauuaccaucacauaucagggccuguuccccuaccagggggaccauggagauauguauguuuacagcgccggccacgcgaccgggacaaccccucaaaaacucuuuguggcuaauuauucccaggacgucaagcaguucgccaacggauuugugguucgcaucggcgccgcugccaauucuacgggcaccgugauuaucagccccuccacaagcgcuaccauuagaaaaaucuacccugccuucaugcuggggucuuccgucggaaacuuuagcgauggcaagauggggcgguucuuuaaucauacacuugugcugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauucuggagugguucggcaucacgcagaccgcccaaggggugcaccucuuuuccucuagauaugucgaccuguacggaggcaauauguuccaguuugcgacacuuccuguuuacgacaccaucaaauauuacagcauuaucccccacuccauucggagcauccagucugaucgcaaggccugggcugccuucuauguguacaaacugcagccgcucacauuucugcuggacuucuccguggauggguauauuagacgggcuaucgacugcggauuuaacgaucucagccaacugcauuguucuuacgagagcuucgacgucgaauccggcguguauucuguuagcuccuuugaggccaagccuagcgggucuguggucgaacaggccgagggaguggagugcgauuucagcccccuucugagcggcaccccuccccagguuuacaacuuuaaacgccucguguucacgaauuguaacuacaauuucacaaagcugcuuucucuguuuuccgucaacgacuuuaccugcagccaaaucucccccgcugcgauugccucuaauuguuauagcucccucauccuggauuacuuuucuuauccucugagcaugaaguccgaccucagcgugucuuccgcuggcccgauuagccaguucaacuacaaacagucuuuuuccaauccuaccugccugauccuugccacagucccccacaaccugaccacaauuacgaagccccucaaauauagcuacaucaauaagugcucuagacugcuuagcgaugaccggaccgaagugccucagcugguuaacgccaaucaauauucccccugugugagcaucgucccgucuacagugugggaggacggggauuacuaccgcaaacagcucuccccucuggaaggaggcggguggcugguugcuagcggauccaccguggccaugacagagcagcuccagaugggcuucgggauuaccguccaauauggcacggacaccaacucugugagccccaagcuggaauuugcgaaugauacaaaaaucgcuucccagcuuggaaacugcguggaguacucucuguauggcguuagcgggagaggagucuuccagaauuguaccgccgugggcgugcggcagcaaagauuugucuacgacgccuaucagaaccucgugggguacuauuccgaugacggaaacuacuacugccugcgcgcuuguguuucugugccugucagcgugauuuaugauaaggagacaaagacccaugccacgcuguucggcuccguugcuugcgaacacaucagcucuacaaugucccaguacagccggucuaccagauccaugcuuaaacgccgggacagcacauaugggccccuccagaccccugugggcuguguccugggacugguuaauucuucccucuuuguggaggauugcaagcugccccuuggccaaagccugugugcccucccggacaccccuuccacacugacgcccuga

SEQ ID NO: 2086 - RNA, 2244 nt, Artificial Sequence
  derived and/or modified CDS sequence (opt5) from MERS-CoV__AKN24812__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucugcguuuauaaacugcagccgcucacauuucugcuggacuucuccguggauggguacaucagacgggcuaucgacuguggauuuaacgaucucagccaacugcauugcucuuaugagagcuucgacguggaauccggcgucuacucugugagcuccuuugaggccaagccuagcgggucuguuguggaacaggccgagggagucgagugugauuucagcccccuucugagcggcaccccuccccagguguauaacuuuaaacgccucguuuucacgaauugcaacuacaauuucacaaagcugcuuucucuguuuuccgugaacgacuucaccuguagccaaauuucccccgcugcgaucgccucuaauugcuacagcucccucauucuggauuauuuuucuuacccucugagcaugaaguccgaccucagcgucucuuccgcuggcccgaucagccaguucaacuauaaacagucuuuuuccaauccuaccugccugauucuugccacagugccccacaaccugaccacaaucacgaagccccucaaauacagcuauaucaauaaguguucuagacugcuuagcgaugaccggaccgaagucccucagcuggugaacgccaaucaauacucccccugcguuagcauugugccgucuacagucugggaggacggggauuauuaccgcaaacagcucuccccucuggaaggaggcggguggcugguggcuagcggauccaccguugccaugacagagcagcuccagaugggcuucgggaucaccgugcaauacggcacggacaccaacucugucugucccaagcuggaauuugcgaaugauacaaaaauugcuagccagcuuggaaacugcguggaguauucccuguacggcgugucugggagaggaguuuuccagaauuguaccgccgucggcgugcggcagcaaagauuuguguaugacgccuaccagaaccucgucggguauuacagcgaugacggaaacuauuacugccugcgcgcuuguguguccguuccugugucugucaucuacgauaaggagacaaagacccaugccacgcuguucggcagcguggcuugcgaacacauuuccagcacaaugucucaguauucccggagcaccagaucuaugcuuaaacgccgggacuccacauacgggccccuccagaccccuguuggcugugugcugggacuggucaauagcucucucuuuguggaggauugcaagcugccccuuggccaaucccugugugcccucccggacaccccuagcacacugacgcccuga

SEQ ID NO: 2087 - RNA, 2244 nt, Artificial Sequence
  derived and/or modified CDS sequence (opt5) from MERS-CoV__AKN24830__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaauuucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggacccaccguugccaugacagagcagcuccagaugggcuucgggaucaccgugcaauauggcacggacaccaacuccgucugcccuaagcuggaauuugcgaaugauacaaaaauugcuucucagcuuggaaacuguguggaguacagccuguauggcguguccgggagaggaguuuuccagaauugcaccgccgucggcgugcggcagcaaagauuuguguacgacgccuaucagaaccucgucggguacuauucugaugacggaaacuacuacugucugcgcgcuugcgugagcguucccguguccgucaucuaugauaaggagacaaagacccaugccacgcuguucggcucuguggcuugugaacacauuagcuccacaaugagccaguacucucgguccaccagaagcaugcuuaaacgccgggacucuacauaugggccucuccagacccccguuggcugcgugcugggacuggucaauuccagccucuuuguggaggauuguaagcugccgcuuggccaaucucugugcgcccucccugacacccccuccacacugacgcccuga

SEQ ID NO: 2088 - RNA, 2244 nt, Artificial Sequence; identical to SEQ ID NO: 2058
  derived and/or modified CDS sequence (opt5) from MERS-CoV__ALB08257__S1

SEQ ID NO: 2089 - RNA, 2244 nt, Artificial Sequence
  derived and/or modified CDS sequence (opt5) from MERS-CoV__ALB08311__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggcuaugcgaccgggacaaccccucaaaaacucuuuguugcuaauuacucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucacacacuuguccugcucccggacggauguggcacccugcugcgcgcguucuauugcauccucgagcccagaucugggaaccauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugggcggaccgaagucccucagcucgugaacgccaaucaauacucccccuguguuagcauugugccgucuacagucugggaggacggagacuacuaucgcaaacagcuguccccucuggaaggcgggggauggcucguggcuagcggcuccaccguugccaugacagagcagcugcagaugggguuuggcaucaccgugcaauacggaacggauaccaacucugucugccccaaacuugaguucgcgaaugacacaaagauugcuagccagcugggcaacuguguggaauauucccucuacggggugucuggaagaggcguuuuucagaauugcaccgccgucggggugcggcagcaaagauucguguaugaugccuaccagaaccuggucggauauuacagcgacgauggcaacuacuauugucugcgcgcuugcguguccguuccugugucugucaucuacgacaaggagacaaagacccacgccacgcuuuuugggagcguggcuugugaacauauuuccagcacaaugucucaguauucccggagcaccagaucuaugcucaaacgccgggauuccacauacggcccccugcagaccccuguuggaugcgugcugggccucgucaauagcucucuguucguggaggacuguaaacuuccccuggggcaaucccucugcgcccugccggauaccccuagcacacugacgcccuga

SEQ ID NO: 2090 - RNA, 2244 nt, Artificial Sequence; identical to SEQ ID NO: 2089
  derived and/or modified CDS sequence (opt5) from MERS-CoV__ALB08322__S1

SEQ ID NO: 2091 - RNA, 2244 nt, Artificial Sequence; identical to SEQ ID NO: 2058
  derived and/or modified CDS sequence (opt5) from MERS-CoV__ALD51904__S1

SEQ ID NO: 2092 - RNA, 2244 nt, Artificial Sequence
  derived and/or modified CDS sequence (opt5) from MERS-CoV__ALJ54446__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuuuuauacguccuucgcuacauaccauacccccgccacagauugcagcgacggcaacuauaaucggaacgcuucucuuaauuccuucaaggaauacuuuaaccuucgcaauuguaccuucauguauaccuacaacauuacagaggaugaaauccuggagugguuuggcaucacgcagaccgcccaaggggugcaccucuucagcuccagauauguggaccuguacggaggcaauauguuucaguucgcgacacuuccugucuacgacaccauuaaauauuacucuaucauuccccacagcauccgguccauucagagcgaucgcaaggccugggcugccuuuuauguuuacaaacugcagccgcucacauuccugcuggacuuuucuguggauggguauaucagacgggcuaucgacugcggauucaacgaucucucccaacugcauuguagcuacgagucuuuugacguggaaagcggcgucuauuccgugucuagcuucgaggccaagccuuccgggagcguuguggaacaggccgagggagucgagugcgauuuuucuccccuucuguccggcaccccuccccagguguacaacuucaaacgccucguuuucacgaauuguaacuacaaucugacaaagcugcugagccucuuuucugugaacgacuucauuugcucccaaaucagccccgcugcgauugccuccaauuguuauucuagccugauccuggauuacuuuuccuauccucucucuaugaaaagcgaccuguccgucagcucugcuggcccgauuucccaguucaacuacaagcagagcuuuucuaauccuaccugccuuauccuggccaccgugccccacaaccucacaaccaucacaaagccccugaaauauuccuacauuaauaagugcagcagacuucugucugaugaccggacggaagucccucagcucgugaacgccaaucaauauagccccuguguuuccaucgugccgagcaccgucugggaggacggggauuacuaccgcaaacagcugucuccucuggaaggaggcggguggcucguggcuuccggaagcacaguugccaugaccgagcagcugcagaugggcuucgggauuacagugcaauauggcaccgacacgaacuccgucugccccaaacuugaauuugcgaaugauaccaagaucgcuucucagcugggaaacuguguggaguacagccucuauggcguguccgggagaggaguuuuccagaauugcacagccgucggcgugcggcagcaaagauuuguguacgacgccuaucagaaccuggucggguacuauucugaugacggaaacuacuacugucugcgcgcuugcgugagcguuccuguguccgucauuuaugauaaggagaccaagacacaugccacccuuuucggcucuguggcuugugaacacaucagcuccacgaugagccaguacucucgguccacaagaagcaugcucaaacgccgggacucuaccuaugggccccugcagacaccuguuggcugcgugcugggacucgucaauuccagccuguuuguggaggauuguaaacuuccccugggccaaucucucugcgcccugccggacaccccuuccacccugacacccuga

SEQ ID NO: 2093 - RNA, 2244 nt, Artificial Sequence
  derived and/or modified CDS sequence (opt5) from MERS-CoV__ALJ54448__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuauucuuaauuccuucaaggaauacuucaaccuucgcaauuguaccuuuauguauaccuacaacaucacagaggaugaaauccuggagugguucggcauuacgcagaccgcccaaggggugcaccucuuuagcuccagauauguggaccuguacggaggcaauauguuccaguuugcgacacuuccugucuacgacaccaucaaauauuacucuauuaucccccacagcauucgguccauccagagcgaucgcaaggccugggcugccuucuauguuuacaaacugcagccgcucacauuucugcuggacuucucuguggauggguauaucagacgggcuauugacugcggauuuaacgaucucucccaacugcauuguagcuacgagucuuucgacguggaaagcggcgucuauuccgugucuagcuuugaggccaagccuuccgggagcguuguggaacaggccgagggagucgagugcgauuucucuccccuucuguccggcaccccuccccagguguacaacuuuaaacgccucguuuucacgaauuguaacuacaaucugacaaagcugcugagccucuucucugugaacgacuuuaccugcucccaaaucagccccgcugcgauugccuccaauuguuauucuagccugauccuggauuacuucuccuauccucucucuaugaaaagcgaccuguccgucagcucugcuggcccgauuucccaguuuaacuacaagcagagcuucucuaauccuaccugccuuauccuggccacagugccccacaaccucaccacaaucacgaagccccugaaauauuccuacauuaauaagugcagcagacuucugucugaugaccggaccgaagucccucagcucgugaacgccaaucaauauagccccuguguuuccaucgugccgagcacagucugggaggacggggauuacuaccgcaaacagcugucuccucuggaaggaggcggguggcucguggcuuccggaagcaccguugccaugacagagcagcugcagaugggcuuugggauuaccgugcaauauggcacggacaccaacuccgucugccccaaacuugaguucgcgaaugauacaaagaucgcuucucagcugggaaacuguguggaauacagccucuauggcguguccgggagaggaguuuuucagaauugcaccgccgucggcgugcggcagcaaagauucguguacgacgccuaucagaaccuggucggguacuauucugaugacggaaacuacuacugucugcgcgcuugcgugagcguuccuguguccgucauuuaugauaaggagacaaagacccaugccacgcuuuuuggcucuguggcuugugaacacaucagcuccacaaugagccaguacucucgguccaccagaagcaugcucaaacgccgggacucuacauaugggccccugcagaccccuguuggcugcgugcugggacucgucaauuccagccuguucguggaggauuguaaacuuccccugggccaaucucucugcgcccugccggacaccccuuccacacugacgcccuga

SEQ ID NO: 2094 - RNA, 2244 nt, Artificial Sequence
  derived and/or modified CDS sequence (opt5) from MERS-CoV__ALJ54450__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucgguacgcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaauucugucugccccaaacuugaguucgcgaacgauacaaagauugcuagccagcugggaaauuguguggaauauucccucuacggcgugucugggagaggaguuuuucagaacugcaccgccgucggcgugcggcagcaaagauucguguaugacgccuaccagaaucuggucggguauuacagcgaugacggaaacuacuauugucugcgcgcuugcguguccguuccugugucugucaucuacgauaaggagacaaagacccaugccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaacagcucucuguucguggaggauuguaaacuuccccugggccaaucccucugcgcccugccggacaccccuagcacacugacgcccuga

SEQ ID NO: 2095 - RNA, 2244 nt, Artificial Sequence
  derived and/or modified CDS sequence (opt5) from MERS-CoV__ALJ54453__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaacuauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuacuauugucugcgcgcuugcguguccguuccugugucugucaucuacgauaaggagacaaagacccacgccacgcuuuuuggcagcguggcuugugaacauauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2096 - RNA, 2244 nt, Artificial Sequence
  derived and/or modified CDS sequence (opt5) from MERS-CoV__ALJ54455__S1
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaggucccucagcucgugaacgcuaaucaauauucccccuguguuagcauugugccgucuacagucugggaagacggggauuacuaccgcaaacagcuguccccucuggagggaggcggguggcucguggccagcggauccaccguugcgaugacagaacagcugcagaugggcuuugggaucaccgugcaauauggcacggacaccaacucugucugccccaaacuugaguucgcuaaugauacaaagauugccagccagcugggaaacuguguggaauacucccucuauggcgugucugggagaggaguuuuucagaauugcaccgccgucggcgugcggcagcaaagauucguguacgacgcuuaucagaaccuggucggguacuauagcgaugacggaaacuacuacugucugcgcgccugcguguccguuccugugucugucaucuaugauaaggagacaaagacccaugcuacgcuuuuuggcagcguggccugugagcacauuuccagcacaaugucucaguacucccggagcaccagaucuaaacucaagcgccgggacuccacauaugggccccugcagaccccuguuggcugcgugcugggacucgucaauagcucucuguucguggaagauuguaaacuuccccugggccaaucccucugcgcgcugccggacaccccuagcacacugaagcccuga

SEQ ID NO: 2097 - RNA, 2244 nt, Artificial Sequence
  derived and/or modified CDS sequence (opt5) from MERS-CoV__ALJ54456__S1
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaggucccucagcucgugaacgcuaaucaauauucccccuguguuagcauugugccgucuacagucugggaagacggggauuacuaccgcaaacagcuguccccucuggagggaggcggguggcucguggccagcggauccaccguugcgaugacagaacagcugcagaugggcuuugggaucaccgugcaauauggcacggacaccaacucugucugccccaaacuugaguucgcuaaugauacaaagauugccagccagcugggaaacuguguggaauacucccucuauggcgugucugggagaggaguuuuucagaauugcaccgccgucggcgugcggcagcaaagauucguguacgacgcuuaucagaaccuggucggguacuauagcgaugacggaaacuacuacugucugcgcgccugcguguccguuccugugucugucaucuaugauaaggagacaaagacccaugcuacgcuuuuuggcagcguggccugugagcacauuuccagcacaaugucucaguacucccggagcaccagaucuaugcucaaacgccgggacuccacauaugggccccugcagaccccuguuggcugcgugcugggacucgucaauagcucucuguucguggaagauuguaaacuuccccugggccaaucccucugcgcgcugccggacaccccuagcacacugaagcccuga

SEQ ID NO: 2098 - RNA, 2244 nt, Artificial Sequence
  derived and/or modified CDS sequence (opt5) from MERS-CoV__ALJ54461__S1
augauccacagcguguuccugcucauguuucugcuuacccccacagaguccuacgucgacguuggcccugauucugugaagccggccugcauugaaguggacauccagcaaacguucuuugauaaaaccuggcccagaccuauugacgucagcaaggcugaugggaucauuuauccccagggacggacauacuccaacaucaccaucacauaucagggccuguucccuuaccagggggaccauggagauauguauguguacucugccggccacgcgaccgggacaacgccccaaaaacucuuuguugcuaauuauagccaggacgugaagcaguucgccaacggauuugucgugcgcauuggcgccgcugccaauuccaccggcaccguuaucauuucuccuagcacauccgcuaccaucagaaaaauuuacccggccuucaugcuggggagcucugugggaaacuuuuccgauggcaagauggggcgguucuuuaaucauacacuuguccugcuccccgacggauguggcacccugcugcgcgcguucuacugcauccucgagccuagaagcgggaaccacugucccgccggaaauucuuauacguccuuugcuacauaccauaccccugccacagauugcagcgacggcaacuauaaucggaacgcuucucuuaauuccuucaaggaauacuucaaccuucgcaauuguaccuuuauguauaccuacaacauuacagaggaugaaauccuggagugguucggcaucacgcagaccgcccaaggggugcaccucuuuagcuccagauauguggaccuguacggaggcaauauguuccaguuugcgacacuucccgucuacgacaccauuaaauauuacucuaucauuccgcacagcauccgguccauucagagcgaucgcaaggccugggcugccuucuauguuuacaaacugcagccucucacauuucugcuggacuucucuguggauggguauaucagacgggcuaucgacugcggauuuaacgaucucucccaacugcauuguagcuacgagucuuucgacguggaaagcggcgucuauuccgugucuagcuuugaggccaagcccuccgggagcguuguggaacaggccgagggagucgagugcgauuucucuccucuucuguccggcaccccuccccagguguacaacuuuaaacgccucguuuucacgaauuguaacuacaaucugacaaagcugcugagccucuucucugugaacgacuuuaccugcucccaaauuagccccgcugcgaucgccuccaauuguuauucuagccugauucuggauuacuucuccuauccgcucucuaugaaaagcgaccuguccgucaccagcgcuggccccaucucucaguuuaacuacaagcaguccuucagcaauccuacaugccuuauucuggccaccgugccccacaaccucacaacgaucaccaagccucugaaauauucuuacaucaauaagugcuccagacuucugagcgaugaccggacagaagucccccagcucgugaacgccaaucaauauucuccguguguuagcauugugccuuccaccgucugggaggacggggauuacuaccgcaaacagcugagcccccuggaaggaggcggguggcucguggcuucuggauccacaguugccaugaccgagcagcugcagaugggcuuugggaucacggugcaauauggcaccgacacaaacagcgucugcccuaaacuugaguucgcgaaugauaccaagauugcuucccagcugggaaacuguguggaauacucucucuauggcgugagcgggagaggaguuuuucagaauugcacagccgucggcgugcggcagcaaagauucguguacgacgccuaucagaaccuggucggguacuauuccgaugacggaaacuacuacugucugcgcgcuugcgugucuguucccgugagcgucaucuaugauaaggagaccaagacgcaugccacacuuuuuggcuccguggcuugugaacacauuucuagcaccaugucccaguacagccggucuacaagauccaugcucaaacgccgggacagcaccuaugggccucugcagaccucuguuggcugcgugcugggacucgucaauuccagccuguucguggaggauuguaaacuuccccugggccaaucucucugcgcccugccggacacaccuuccacgcugacccccuga

SEQ ID NO: 2099 - RNA, 2244 nt, Artificial Sequence
  derived and/or modified CDS sequence (opt5) from MERS-CoV__ALJ54468__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuauuugcagccaaaucucccccgcugcgauugccucuaauuguuauagcucccugauccuggauuacuucucuuauccucucagcaugaaguccgaccugagcgucucuuccgcuggcccgauuagccaguuuaacuacaagcagucuuucuccaauccuaccugccuuauccuggccaccgugccccacaaccucacaaccaucacaaagccccugaaauauagcuacauuaauaagugcucuagacuucugagcgaugaccggacggaagucccucagcucgugaacgccaaucaauauucccccuguguuagcaucgugccgucuaccgucugggaggacggggauuacuaccgcaaacagcuguccccucuggaaggaggcggguggcucguggcuagcggauccacaguugccaugaccgagcagcugcagaugggcuuugggauuacagugcaauauggcaccgacacgaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacacaugccacccuuuuuggcagcguggcuugugaacacaucuccagcacgaugucucaguacucccggagcacaagaucuaugcucaaacgccgggacuccaccuaugggccccugcagacaccuguuggcugcgugcugggacucgucaauagcucucuguucguggaggauuguaaacuuccccugggccaaucccucugcgcccugccggacaccccuagcacccugacacccuga

SEQ ID NO: 2100 - RNA, 2244 nt, Artificial Sequence
  derived and/or modified CDS sequence (opt5) from MERS-CoV__ALJ54471__S1
augauccacagcguguaccugcucauguuccugcuuacccccacagaguccuaugucgacguuggcccugauucugucaagagcgccugcauugaaguggacauccagcaaacguuuuucgauaaaaccuggccgagacccauugacguguccaaggcugaugggaucauuuacccucagggacggacauauucuaacaucaccaucacauaccagggccuguuucccuaucagggggaccauggagauauguacguguauagcgccggccacgcgaccgggacaaccccucaaaaacucuucguugcuaauuacucccaggacgugaagcaguuugccaacggauucgucgugcgcauuggcgccgcugccaauucuacgggcaccguuaucauuagccccuccacaagcgcuaccaucagaaaaauuuacccugccuuuaugcuggggucuuccgugggaaacuucagcgauggcaagauggggcgguuuuucaaucauacacuuguccugcucccggacggauguggcacccugcugcgcgcguuuuauugcauccucgagcccagaucugggaaccacuguccugccggaaauuccuacacgagcuucgcuacauaucauacccccgccacagauugcucugacggcaacuacaaucggaacgcuucccugaauagcuuuaaggaauauuucaaccuucgcaauuguaccuucauguacaccuauaacauuacagaggaugaaauccuggagugguuuggcaucacgcagaccgcccaaggggugcaccucuucuccucuagauacguggaccuguacggaggcaauauguuucaguucgcgacacuuccugucuaugacaccauuaaauacuauagcaucauuccccacuccauccggagcauucagucugaucgcaaggccugggcugccuuuuacguuuauaaacugcagccgcucacauuccugcuggacuuuuccguggauggguacaucagacgggcuaucgacugcggauucaacgaucucagccaacugcauuguucuuaugagagcuuugacguggaauccggcgucuacucugugagcuccuucgaggccaagccuagcgggucuguuguggaacaggccgagggagucgagugcgauuuuagcccccuucuguccggcaccccuccccagguguacaacuucaaacgccucguuuuuacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguucaacuauaagcagucuuuuuccaauccuaccugccuuauucuggccacagugccccacaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuucgggaucaccgugcaauacggcacggacaccaacucugucugccccaaacuugaauuugcgaaugauacaaagauugcuagccagcugggaaacuguguggaguauucccucuacggcgugucugggagaggaguuuuccagaauugcaccgccgucggcgugcggcagcaaagauuuguguaugacgccuaccagaaccuggucggguauuacagcgaugacggaaacuacuauugucugcgcgcuugcguguccguuccugugucugucaucuacgauaaggagacaaagacccaugccacgcuuuucggcagcguggcuugugaacacauuuccagcacaaugucucaguauucccggagcaccagaucuaugcucaaacgccgggacuccacauacgggccccugcagaccccuguuggcugcgugcugggacucgucaauagcucucuguuuguggaggauuguaaacuuccccugggccaaucccucugcgcccugccggacaccccuagcacacugacgcccuga

SEQ ID NO: 2101 - RNA, 2244 nt, Artificial Sequence
  derived and/or modified CDS sequence (opt5) from MERS-CoV__ALJ54472__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcugcagcaacgguucguguacgacgccuaucagaaccuggucggguacuauagcgaugacggaaacuacuacugucuuagagcuugcguguccguuccugugucugucaucuaugauaaggagacaaagacccaugccacgcucuuuggcagcguggcuugugaacacauuuccagcacaaugucucaguacucccgcagcacccggucuaugcugaaaagacgcgacuccacauaugggccccugcagaccccuguuggcugcgugcucggacuggucaauagcucucuuuucguggaggauuguaagcugccccucggccaaucccugugcgcccugccggacaccccuagcacacuugcgcccuga

SEQ ID NO: 2102 - RNA, 2244 nt, Artificial Sequence
  derived and/or modified CDS sequence (opt5) from MERS-CoV__ALJ54474__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccucuacagauugcuccgacggcaacuauaaucggaacgccagccuuaauuccuucaaggaauacuucaaccuucgcaauuguaccuuuauguauaccuacaacauuacagaggaugaaauccuggagugguucggcaucacgcagaccgcucaaggggugcaccucuuuucuagcagauauguggaccuguacggaggcaauauguuccaguuugccacacuuccugucuacgacaccauuaaauauuacuccaucauuccccacagcauccggucuauucaguccgaucgcaaggcgugggccgcuuucuauguuuacaaacugcagccgcucacauuucugcuggacuucagcguggauggguauaucagacgggccaucgacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcaccccuccccagguguacaacuuuaaacgccucguuuucacgaauuguaacuacaaucugacaaagcugcugucccucuucagcgugaacgacuuuaccugcucccaaauuucucccgccgcuaucgcgagcaauuguuauuccucucugauucuggauuacuucagcuauccucucuccaugaaaagcgaccugucugucuccagcgccggcccgaucucucaguuuaacuacaagcaguccuucagcaauccuaccugccuuauucuggcuacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggagaggaguuuuucagaauugcaccgcugucggcgugcggcagcaaagauucguguacgacgccuaucagaaccuggucggguacuauuccgaugacggaaacuacuacugucugcgcgccugcgugucuguuccugugagcgucaucuaugauaaggagacaaagacccaugcuacgcuuuuuggcuccguggccugugaacacauuagcucuacaaugucccaguacagccggucuaccagauccaugcucaaacgccgggacagcacauaugggccccugcagaccccuguuggcugcgugcugggacucgucaauucuucccuguucguggaggauuguaaacuuccccugggccaaagccucugcgcucugccggacaccccuuccacacugacgcccuga

SEQ ID NO: 2103 - RNA, 2244 nt, Artificial Sequence
  derived and/or modified CDS sequence (opt5) from MERS-CoV__ALJ54483__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucuuucaguucaacuacaagcagagcuuuucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggggauuacuaccgcaaacagcugucuccucuggaaggaggcggguggcucguggcuuccggaagcaccguugccaugacagagcagcugcagaugggcuucgggaucaccgugcaauauggcacggacaccaacuccgucugccccaaacuugaauuugcgaaugauacaaagauugcuucucagcugggaaacuguguggaguacagccucuauggcguguccgggagaggaguuuuccagaauugcaccgccgucggcgugcggcagcaaagauuuguguacgacgccuaucagaaccuggucggguacuauucugaugacggaaacuacuacugucugcgcgcuugcgugagcguuccuguguccgucaucuaugauaaggagacaaagacccaugccacgcuuuucggcucuguggcuugugaacacauuagcuccacaaugagccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccuga

SEQ ID NO: 2104 - RNA, 2244 nt, Artificial Sequence
  derived and/or modified CDS sequence (opt5) from MERS-CoV__ALJ54486__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucgguacgcuucccugaacagcuucaaggaauauuucaaucuucgcaacuguaccuuuauguacaccuauaauauuacagaggaugaaauccuggagugguucggcaucacgcagaccgcccaaggggugcaccucuuuuccucuagauacguggaccuguacggaggcaacauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaaugaucucagccaacugcauuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaacuguaauuauaaccugacaaaacuucugucucucuucuccgugaaugacuuuaccugcagccaaauuucccccgcugcgaucgccucuaacuguuacagcucccugauucuggauuauuucucuuacccucucagcaugaaguccgaccugagcgucucuuccgcuggcccgaucagccaguuuaauuauaagcagucuuucuccaacccuaccugccuuauucuggccacagugccccacaaucucaccacaaucacgaagccccugaaauacagcuauaucaacaagugcucuagacuucugagcgaugaccggaccgaagucccucagcucgugaaugccaaccaauacucccccuguguuagcauugugccgucuacagucugggaggacggggauuacuaucgcaaacagcuguccccucuggaaggaggcggguggcucgugguuagcggauccaccguggcuaugacagagcagcugcagaugggcuuugggaucaccguccaauacggcacggacaccaauucugugugccccaaacuugaguucgccaacgauacaaagauugcgagccagcugggaaauuguguggaauauucccucuacggcguuucugggagaggagucuuucagaacugcaccgcugugggcgugcggcagcaaagauucgucuaugacgccuaccagaaucuggugggguauuacagcgaugacggaaacuacuauugucugcgcgccugcguuuccgugccugucucugugaucuacgauaaggagacaaagacccaugcuacgcuuuuuggcagcguugccugugaacacauuuccagcacaaugucucaguauucccggagcaccagaucuaugcucaaacgccgggacuccacauacgggccccugcagaccccugugggcugcguccugggacucgugaacagcucucuguucguugaggauuguaaacuuccccugggccaaucccucugcgcucugccggacaccccuagcacacugacgcccuga

SEQ ID NO: 2105 - RNA, 2244 nt, Artificial Sequence
  derived and/or modified CDS sequence (opt5) from MERS-CoV__ALJ54488__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauuuauguguacagcgccggccacgcgaccgggacaaccccucaaaaacucuuuguugcuaauuauucccaggacgugaagcaguucgccaacggauuugucgugcgcaucggcgccgcugccaauucuacgggcaccguuauuaucagccccuccacaagcgcuaccauuagaaaaaucuacccugccuucaugcuggggucuuccgugggaaacuuuagcgauggcaagauggggcgguucuuuaaucauacacuuguccugcucccggacggauguggcacccugcugcgcgcguucuacugcauucucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacaucacagaggaugaaauccuggagugguucggcauuacgcagaccgcccaaggggugcaccucuuuuccucuagauauguggaccuguacggaggcaauauguuccaguuugcgacacuuccugucuacgacaccaucaaauauuacagcauuaucccccacuccauucggagcauccagucugaucgcaaggccugggcugccuucuauguuuacaaacugcagccgcucacauuucugcuggacuucuccguggauggguauaucagacgggcuauugacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaaucucccccgcugcgauugccucuaauuguuauagcucccugauccuggauuacuucucuuauccucucagcaugaaguccgaccugagcgucucuuccgcuggcccgauuagccaguuuaacuacaagcagucuuucuccaauccuaccugccuuauccuggccacagugccccacaaccucaccacaaucacgaagccccugaaauauagcuacauuaauaagugcucuagacuucugagcgaugaccggaccgaagucccucagcucgugaacgccaaucaauauucccccuguguuagcaucgugccgucuacagucugggaggacggggauuacuaccgcaaacagcuguccccucuggaaggaggcggguggcucguggcuagcggauccaccguugccaugacagagcagcugcagaugggcuuugggauuaccgugcaauauggcacggacaccaacucugucugccccaaacuugaguucgcgaaugauacaaagaucgcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucauuuaugauaaggagacaaagacccaugccacgcuuuuuggcagcguggcuugugaacacaucuccagcacaaugucucaguacucccggagcaccagaucuaugcucaaacgccgggacuccacauaugggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2106 - RNA, 2244 nt, Artificial Sequence
  derived and/or modified CDS sequence (opt5) from MERS-CoV__ALJ54490__S1
augauccacagcguguuccugcucauguuucugcuuacccccacagaguccuacgucgacguuggcccugauucugugaaguccgccugcauugcuguggacauccagcaaacguucuuugauaaaaccuggccgagacccauugacgucuccaaggccgaugggaucauuuauccucagggacggacauacucuaacaucaccaucacauaucagggccuguuccccuaccagggggaccauggagauauguauguguacagcgcgggccacgcuaccgggacaaccccucaaaaacucuuuguugccaauuauucccaggacgugaagcaguucgccaacggauuugucgugcgcauuggcgcugccgcuaauucuacgggcaccguuaucauuagccccuccacaagcgccaccaucagaaaaauuuacccugcguucaugcuggggucuuccgugggaaacuuuagcgauggcaagauggggcgguucuuuaaucauacacuuguccugcucccggacggauguggcacccugcugcgcgccuucuacugcauccucgaacccagaucugggaaccacuguccugcuggaaauuccuauacgagcuuugccacauaccauacccccgcuacagauugcucugacggcaacuauaaucggaacgccucccugaauagcuucaaggaguacuucaaccuucgcaauuguaccuuuauguauaccuacaacauuacagaagaugagauccuggaaugguucggcaucacgcagaccgcgcaaggggugcaccucuuuuccucuagauauguggaccuguacggaggcaauauguuccaguuugccacacuuccugucuacgacaccauuaaauauuacagcaucauuccccacuccauccggagcauucagucugaucgcaaggcuugggccgcuuucuauguuuacaaacugcagccgcucacauuucugcuggacuucuccguggauggguauaucagacgggccaucgacugcggauuuaacgaucucagccaacugcauuguucuuacgagagcuucgacguggaguccggcgucuauucugugagcuccuuugaagccaagccuagcgggucuguuguggagcaggcugaaggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcggccaucgcuucuaauuguuauagcucccugauucuggauuacuucucuuauccucucagcaugaaguccgaccugagcgucucuuccgccggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugggcggaccgaggucccucagcucgugaacgcuaaucaauauucccccuguguuagcauugugccgucuacagucugggaagacggagacuacuaccgcaaacagcuguccccucuggagggcgggggauggcucguggccagcggcuccaccguugcgaugacagaacagcugcagaugggguuuggcaucaccgugcaauauggaacggauaccaacucugucugccccaaacuugaguucgcuaaugacacaaagauugccagccagcugggcaacuguguggaauacucccucuauggggugucuggaagaggcguuuuucagaauugcaccgccgucggggugcggcagcaaagauucguguacgaugcuuaucagaaccuggucggauacuauagcgacgauggcaacuacuacugucugcgcgccugcguguccguuccugugucugucaucuaugacaaggagacaaagacccaugcuacgcuuuuugggagcguggccugugagcacauuuccagcacaaugucucaguacucccggagcaccagaucuaugcucaaacgccgggauuccacauauggcccccugcagaccccuguuggaugcgugcugggccucgucaauagcucucuguucguggaagacuguaaacuuccccuggggcaaucccucugcgcgcugccggauaccccuagcacacugaagcccuga

SEQ ID NO: 2107 - RNA, 2244 nt, Artificial Sequence
  derived and/or modified CDS sequence (opt5) from MERS-CoV__ALJ54495__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucgugguuagcggauccaccguggcuaugacagagcagcugcagaugggcuuugggaucaccguccaauauggcacggacaccaacucugugugccccaaacuugaguucgccaaugauacaaagauugcgagccagcugggaaacuguguggaauacucccucuauggcguuucugggagaggagucuuucagaauugcaccgcugugggcgugcggcagcaaagauucgucuacgacgccuaucagaaccuggugggguacuauagcgaugacggaaacuacuacugucugcgcgccugcguuuccgugccugucucugugaucuaugauaaggagacaaagacccaugcuacgcuuuuuggcagcguugccugugaacacauuuccagcacaaugucucaguacucccggagcaccagaucuaugcucaaacgccgggacuccacauaugggccccugcagaccccugugggcugcguccugggacucgugaauagcucucuguucguugaggauuguaaacuuccccugggccaaucccucugcgcucugccggacaccccuagcacacugacgcccuga

SEQ ID NO: 2108 - RNA, 2244 nt, Artificial Sequence
  derived and/or modified CDS sequence (opt5) from MERS-CoV__ALJ54496__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuuccuagcgaugaccggaccgaagucccccagcuggugaacgccaaucaauauuccccguguguuagcauugugccuucuacagucugggaggacggggauuacuaccgcaaacagcucagcccccuggaaggaggcggguggcugguggcuuccggauccaccguugccaugacagagcagcuccagaugggcuuugggaucaccgugcaauauggcacggacaccaacucugucugcccuaagcuggaguucgcgaaugauacaaaaauugcuagccagcuuggaaacuguguggaauacucccuguauggcgugucugggagaggaguuuuucagaauugcaccgccgucggcgugcggcagcaaagauucguguacgacgccuaucagaaccucgucggguacuauagcgaugacggaaacuacuacugucugcgcgcuugcguguccguucccgugucugucaucuaugauaaggagacaaagacccaugccacgcuguuuggcagcguggcuugugaacacauuuccagcacaaugucucaguacucccggagcaccagaucuaugcuuaaacgccgggacuccacauaugggccucuccagacccccguuggcugcgugcugggacuggucaauagcucucucuucguggaggauuguaagcugccgcuuggccaaucccugugcgcccucccugacacccccagcacacugacgcccuga

SEQ ID NO: 2109 - RNA, 2244 nt, Artificial Sequence
  derived and/or modified CDS sequence (opt5) from MERS-CoV__ALJ54500__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucucccuucugcucagcggcacgcccccucagguguacaacuuuaaacgccugguuuucaccaauuguaacuacaaucuuacaaagcugcucucucuguucuccgugaacgacuuuaccugcagccaaauuucccccgcugcgaucgccucuaauuguuauagcucccugauucucgauuacuucucuuauccccugagcaugaaguccgaccuuagcgucucuuccgcuggcccuaucagccaguuuaacuacaaacagucuuucuccaauccgaccugccugauucucgccacagugccccacaaccugaccacaaucacgaagccucuuaaauauagcuacaucaauaagugcucuagacugcucagcgaugaccggaccgaagucccccagcuggugaacgccaaucaauauuccccuuguguuagcauugugcccucuacagucugggaggacggggauuacuaccgcaaacagcuguccccgcucgaaggaggcggguggcugguggcuagcggauccaccguugccaugacagagcagcuucagaugggcuuugggaucaccgugcaauauggcacggacaccaacucugucugcccuaagcuggaguucgcgaaugauacaaaaauugcuagccagcucggaaacuguguggaauacucccuguauggcgugucugggagaggaguuuuucagaauugcaccgccgucggcgugcggcagcaaagauucguguacgacgccuaucagaaccuggucggguacuauagcgaugacggaaacuacuacugucuucgcgcuugcguguccguucccgugucugucaucuaugauaaggagacaaagacccaugccacgcucuuuggcagcguggcuugugaacacauuuccagcacaaugucucaguacucccggagcaccagaucuaugcugaaacgccgggacuccacauaugggccucugcagacccccguuggcugcgugcucggacuggucaauagcucucuuuucguggaggauuguaagcugccucucggccaaucccugugcgcccugcccgacaccccgagcacacuuacgccuuga

SEQ ID NO: 2110 - RNA, 2244 nt, Artificial Sequence
  derived and/or modified CDS sequence (opt5) from MERS-CoV__ALJ54501__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacacugugggaggacggggauuacuaccgcaaacagcuguccccucucgaaggaggcggguggcuggucgcuagcggauccaccguggccaugacagagcagcuucagaugggcuuugggaucaccguucaauauggcacggacaccaacucugugugccccaagcuggaguucgcgaaugauacaaaaauugcuagccagcucggaaacugugucgaauacucccuguauggcgugucugggagaggaguguuucagaauugcaccgccguuggcguccggcagcaaagauucguguacgacgccuaucagaaccuggugggguacuauagcgaugacggaaacuacuacugucuucgcgcuugcgucuccgugccuguuucugugaucuaugauaaggagacaaagacccaugccacgcucuuuggcagcgucgcuugugaacacauuuccagcacaaugucucaguacucccggagcaccagaucuaugcugaaacgccgggacuccacauaugggccccugcagaccccugugggcugcguucucggacuggugaauagcucucuuuucgucgaggauuguaagcugccccucggccaaucccugugcgcccugccggacaccccuagcacacuuacgcccuga

SEQ ID NO: 2111 - RNA, 2244 nt, Artificial Sequence; identical to SEQ ID NO: 2058
  derived and/or modified CDS sequence (opt5) from MERS-CoV__ALJ54502__S1

SEQ ID NO: 2112 - RNA, 2244 nt, Artificial Sequence
  derived and/or modified CDS sequence (opt5) from MERS-CoV__ALJ54512__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggcgcaccucuuuuccucuagauauguggaccuguacggaggcaauauguuccaguuugccacacuuccuguguacgacaccauuaaauauuacagcaucauuccccacuccauccggagcauucagucugaucgcaaggcuugggccgcuuucuaugucuacaaacugcagccgcucacauuucugcuggacuucuccguugauggguauaucagacgggccaucgacugcggauuuaacgaucucagccaacugcauuguucuuacgagagcuucgacguggaauccggcguguauucugucagcuccuuugaggccaagccuagcgggucugugguugaacaggcugagggaguggagugcgauuucagcccccuucuguccggcaccccuccccaggucuacaacuuuaaacgccucguguucacgaauuguaacuacaaucugacaaaacuucugucucucuucuccguuaacgacuuuaccugcagccaaauuucccccgcggccaucgcuucuaauuguuauagcucccugauucuggauuacuucucuuauccucucagcaugaaguccgaccugagcgugucuuccgccggcccgaucagccaguuuaacuacaagcagucuuucuccaauccuaccugccuuauucuggccacagucccccacaaccucaccacaaucacgaagccccugaaauauagcuacaucaauaagugcucuagacuucugagcgaugaccggaccgaagugccucagcucgucaacgcuaaucaauauucccccugugugagcauuguuccgucuacagugugggaggacggggauuacuaccgcaaacagcuguccccucuggaaggaggcggguggcucgucgccagcggauccaccguggcgaugacagagcagcugcagaugggcuuugggaucaccguucaauauggcacggacaccaacucugugugccccaaacuugaguucgcuaaugauacaaagauugccagccagcugggaaacugugucgaauacucccucuauggcgugucugggagaggaguguuucagaauugcaccgccguuggcguccggcagcaaagauucguguacgacgcuuaucagaaccuggugggguacuauagcgaugacggaaacuacuacugucugcgcgccugcgucuccgugccuguuucugugaucuaugauaaggagacaaagacccaugcuacgcuuuuuggcagcgucgccugugaacacauuuccagcacaaugucucaguacucccggagcaccagaucuaugcucaaacgccgggacuccacauaugggccccugcagaccccugugggcugcguucugggacucgugaauagcucucuguucgucgaggauuguaaacuuccccugggccaaucccucugcgcgcugccggacaccccuagcacacugacgcccuga

SEQ ID NO: 2113 - RNA, 2244 nt, Artificial Sequence
  derived and/or modified CDS sequence (opt5) from MERS-CoV__ALJ54517__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacgggaacuacuaccgcaaacagcuguccccucuggaaggaggcggguggcucguggcuagcggauccaccguugccaugacagagcagcugcagaugggcuuugggaucaccgugcaauauggcacggauaccaauucugucugccccaaacuugaguucgcgaacgacacaaagauugcuagccagcugggaaauuguguggaauacucccucuauggcgugucugggagaggaguuuuucagaacugcaccgccgucggcgugcggcagcaaagauucguguacgaugccuaucagaaccuggucggguacuauagcgacgauggaaauuacuacugucugcgcgcuugcguguccguuccugugucugucaucuaugacaaggagacaaagacccaugccacgcuuuuuggcagcguggcuugugaacacauuuccagcacaaugucucaguacucccggagcaccagaucuaugcucaaacgccgggauuccacauaugggccccugcagaccccuguuggcugcgugcugggacucgucaacagcucucuguucguggaggacuguaaacuuccccugggccaaucccucugcgcccugccggauaccccuagcacacugacgcccuga

SEQ ID NO: 2114 - RNA, 2244 nt, Artificial Sequence; identical to SEQ ID NO: 2108
  derived and/or modified CDS sequence (opt5) from MERS-CoV__ALJ54518__S1

SEQ ID NO: 2115 - RNA, 2244 nt, Artificial Sequence
  derived and/or modified CDS sequence (opt5) from MERS-CoV__ALW82691__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucggagcgaugaccgcaccgaagucccucagcuggugaacgccaaucaauauucccccuguguuagcauugugccgucuacagucugggaggacggggauuacuacagaaaacagcucuccccucuggaaggaggcggguggcugguggcuagcggauccaccguugccaugacagagcagcuccagaugggcuuugggaucaccgugcaauauggcacggacaccaacucugucugccccaagcuggaguucgcgaaugauacaaaaauugcuagccagcuuggaaacuguguggaauacucccuguauggcgugucugggcggggaguuuuucagaauugcaccgccgucggcgugagacagcaacgcuucguguacgacgccuaucagaaccucgucggguacuauagcgaugacggaaacuacuacugucugcgggcuugcguguccguuccugugucugucaucuaugauaaggagacaaagacccaugccacgcuguuuggcagcguggcuugugaacacauuuccagcacaaugucucaguacuccagaagcacccgcucuaugcuuaaacggagagacuccacauaugggccccuccagaccccuguuggcugcgugcugggacuggucaauagcucucucuucguggaggauuguaagcugccccuuggccaaucccugugcgcccucccggacaccccuagcacacugacgcccuga

SEQ ID NO: 2116 - RNA, 2244 nt, Artificial Sequence
  derived and/or modified CDS sequence (opt5) from MERS-CoV__ALW82742__S1
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccauccagaaaauuuacccugccuucaugcuggggucuuccgugggaaacuuuagcgauggcaagauggggagauucuuuaaucauacacuuguccugcucccggacggauguggcacccugcugcgggcguucuacugcauccucgagccccgcucugggaaccacuguccugccggaaauuccuauacgagcuuugcuacauaccauacccccgccacagauugcucugacggcaacuauaauagaaacgcuucccugaauagcuucaaggaauacuucaaccuucggaauuguaccuuuauguauaccuacaacauuacagaggaugaaauccuggagugguucggcaucacgcaaaccgcccagggggugcaccucuuuuccucucgcuauguggaccuguacggaggcaauauguuccaguuugcgacacuuccugucuacgacaccauuaaauauuacagcaucauuccccacuccaucagaagcauucagucugaucggaaggccugggcugccuucuauguuuacaaacugcaaccgcucacauuucugcuggacuucuccguggauggguauauccgcagagcuaucgacugcggauuuaacgaucucagccagcugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccaaguguacaacuuuaaacggcucguuuucacgaauuguaacuacaaucugacaaaacuucugucucucuucuccgugaacgacuuuaccugcagccagauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucucgccuucugagcgaugacagaaccgaagucccucaacucgugaacgccaaucaguauucccccuguguuagcauugugccgucuacagucugggaggacggggauuacuaccggaaacagcuguccccucuggaaggaggcggguggcucguggcuagcggauccaccguugccaugacagagcagcugcaaaugggcuuugggaucaccgugcaguauggcacggacaccaacucugucugccccaaacuugaguucgcgaaugauacaaagauugcuagccagcugggaaacuguguggaauacucccucuauggcgugucugggcgcggaguuuuucagaauugcaccgccgucggcgugagacaacagcgguucguguacgacgccuaucagaaccuggucggguacuauagcgaugacggaaacuacuacugucugagagcuugcguguccguuccugugucugucaucuaugauaaggagacaaagacccaugccacgcuuuuuggcagcguggcuugugaacacauuuccagcacaaugucucaguacucccgcagcacccggucuaugcucaaaagacgcgacuccacauaugggccccugcaaaccccuguuggcugcgugcugggacucgucaauagcucucuguucguggaggauuguaaacuuccccugggccagucccucugcgcccugccggacaccccuagcacacugacgcccuga

SEQ ID NO: 2117 - RNA, 2244 nt, Artificial Sequence; identical to SEQ ID NO: 2102
  derived and/or modified CDS sequence (opt5) from MERS-CoV__ALW82753__S1

SEQ ID NO: 2118 - RNA, 2244 nt, Artificial Sequence
  derived and/or modified CDS sequence (opt5) from MERS-CoV__ALX27228__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucuggaaagacggggauuacuaccgcaagcagcuguccccucuggagggaggcggguggcucguggcuagcggauccaccguugccaugacagaacagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaaaacccaugccacgcuuuuuggcagcguggcuugugagcacauuuccagcacaaugucucaguacucccggagcaccagaucuaugcucaagcgccgggacuccacauaugggccccugcagaccccuguuagcugcgugcugggccucgucaauucuucccuguucguggaagauuguaaacuuccccugggacaaagccucugcgcccugccggacaccccuuccacacugacgcccuga

SEQ ID NO: 2119 - RNA, 2244 nt, Artificial Sequence; identical to SEQ ID NO: 2060
  derived and/or modified CDS sequence (opt5) from MERS-CoV__ALX27232__S1

SEQ ID NO: 2120 - RNA, 2244 nt, Artificial Sequence
  derived and/or modified CDS sequence (opt5) from MERS-CoV__AMQ48993__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaucguugccaugaccgagcagcugcagaugggcuuugggauuacagugcaauauggcaccgacacgaacucugucugccccaaacuugaguucgcgaaugauaccaagaucgcuagccagcugggaaacuguguggaauacucccucuauggcgugucugggagaggaguuuuucagaauugcacagccgucggcgugcggcagcaaagauucguguacgacgccuaucagaaccuggucggguacuauagcgaugacggaaacuacuacugucugcgcgcuugcguguccguuccugugucugucauuuaugauaaggagaccaagacacaugccacccuuuuuggcagcguggcuugugaacacaucuccagcacgaugucucaguacucccggagcacaagaucuaugcucaaacgccgggacuccaccuaugggccccugcagacaccuguuggcugcgugcugggacucgucaauagcucucuguucguggaggauuguaaacuuccccugggccaaucccucugcgcccugccggacaccccuagcacccugacacccuga

SEQ ID NO: 2121 - RNA, 2244 nt, Artificial Sequence
  derived and/or modified CDS sequence (opt5) from MERS-CoV__AMW90844__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccuuccaauauggcacggacaccaacucugugugccccaaacuugaauuugcgaaugauacaaagauugcuagccagcugggaaacugugucgaguacucccucuauggcgugucugggagaggaguguuccagaauugcaccgccguuggcguccggcagcaaagauuuguguacgacgccuaucagaaccuggugggguacuauagcgaugacggaaacuacuacugucugcgcgcuugcgucuccgugccuguuucugugaucuaugauaaggagacaaagacccaugccacgcuuuucggcagcgucgcuugugaacacauuuccagcacaaugucucaguacucccggagcaccagaucuaugcucaaacgccgggacuccacauaugggccccugcagaccccugugggcugcguucugggacucgugaauagcucucuguuugucgaggauuguaaacuuccccugggccaaucccucugcgcccugccggacaccccuagcacacugacgcccuga

SEQ ID NO: 2122 - RNA, 2244 nt, Artificial Sequence; identical to SEQ ID NO: 2074
  derived and/or modified CDS sequence (opt5) from MERS-CoV__AMW90852__S1

SEQ ID NO: 2123 - RNA, 2244 nt, Artificial Sequence
  derived and/or modified CDS sequence (opt5) from MERS-CoV__AMW90853__S1
augauccacagcguguuccugcucauguuucugcuuacccccacagaguccuacgucgacguuggcucugauagcgugaaguccgccugcauugaaguggacauccagcaaacguucuuugauaaaaccuggccuagaccgauugacgucucuaaggcugaugggaucauuuauccccagggacggacauacagcaacaucaccaucacauaucagggccuguucccuuaccagggggaccauggagauauguauguguacuccgccggcuaugcgaccgggacaacgccccaaaaacucuuuguugcuaauuacucucaggacgugaagcaguucgccaacggauuugucgugcgcauuggcgccgcugccaauagcaccggcaccguuaucauuuccccuagcacaucugcuaccaucagaaaaauuuaccccgccuucaugcugggguccagcgugggaaacuuuucugauggcaagauggggcgguucuuuaaucacacacuuguccugcucccugacggauguggcacccugcugcgcgcguucuauugcauccucgagccgagauccgggaaccauugucccgccggaaauagcuacacgucuuuugcuacauaucacaccccugccacagauugcuccgacggcaacuacaaucggaacgcuagccugaauagcuucaaggaauauuucaaccuucgcaauuguaccuuuauguacaccuauaacauuacagaggaugaaauccuggagugguucggcaucacgcagaccgcccaaggggugcaucucuuuucuagcagauacguggaccuguacggaggcaauauguuccaguuugcgacacuucccgucuaugacaccauuaaauacuauuccaucauuccucacagcauccggucuauucaguccgaucgcaaggccugggcugccuucuacguuuauaaacugcagccccucacauuucugcuggacuucagcguggauggguacaucagacgggcuaucgacugcggauuuaacgaucucucucaacugcacuguagcuaugaguccuucgacguggaaucuggcgucuacagcguguccagcuuugaggccaagccgucuggguccguuguggaacaggccgagggagucgagugcgauuucagcccucuucugucuggcacgcccccucagguguacaacuuuaaacgccucguuuucaccaauuguaacuauaauuucacaaagcugcuuucccuguuuagcgugaacgacuuuaccugcucccaaauuucucccgcugcgaucgccagcaauuguuacuccucucucauucuggauuauuucagcuacccccuguccaugaaguccgaccucucugucuccagcgcuggcccuaucucucaguucaacuauaaacaguccuuuagcaauccgaccugccugauucuugccacagugccccauaaccugaccacaaucacgaagccucucaaauacucuuauaucaauaagugcagcagacugcuuuccgaugaccggaccgaagucccccagcuggugaacgccaaucaauacagcccuuguguuucuauugugcccuccacagucugggaggacggggauuacuaucgcaaacagcucagcccgcuggaaggaggcggguggcugguggcuuccggaucuaccguugccaugacagagcagcuccagaugggcuucgggaucaccgugcaauacggcacggacaccaacagcgucugcccuaagcuggaauuugcgaaugauacaaaaauugcuucccagcuuggaaacuguguggaguauucucuguacggcgugagcgggagaggaguuuuccagaauugcaccgccgucggcgugcggcagcaaagauuuguguaugacgccuaccagaaccucgucggguauuacuccgaugacggaaacuacuauugucugcgcgcuugcgugucuguucccgugagcgucaucuacgauaaggagacaaagacccacgccacgcuguucggcuccguggcuugugaacauauuagcucuacaaugucccaguauagccggucuaccagauccaugcuuaaacgccgggacagcacauacgggccucuccagacccccguuggcugcgugcugggacuggucaauucuucccucuuuguggaggauuguaagcugccucuuggccaaagccugugcgcccuccccgacaccccguccacacugacgccuuga

SEQ ID NO: 2124 - RNA, 2244 nt, Artificial Sequence
  derived and/or modified CDS sequence (opt5) from MERS-CoV__ANC28656__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugggcggaccgaagucccucagcucgugaacgccaaucaauauucccccuguguuagcauugugccgucuacagucugggaggacggagacuacuaccgcaaacagcuguccccucuggaaggcgggggauggcucguggcuagcggcuccaccguugccaugacagagcagcugcagaugggguuuggcaucaccgugcaauauggaacggauaccaacucugucugccccaaacuugaguucgcgaaugacacaaagauugcuagccagcugggcaacuguguggaauacucccucuauggggugucuggaagaggcguuuuucagaauugcaccgccgucggggugcggcagcaaagauucguguacgaugccuaucagaaccuggucggauacuauagcgacgauggcaacuacuacugucugcgcgcuugcguguccguuccugugucugucaucuaugacaaggagacaaagacccaugccacgcuuuuugggagcguggcuugugaacacauuuccagcacaaugucucaguacucccggagcaccagaucuaugcucaaacgccgggauuccacauauggcccccugcagaccccuguuggaugcgugcugggccucgucaauagcucucuguucguggaggacuguaaacuuccccuggggcaaucccucugcgcccugccggauaccccuagcacacugacgcccuga

SEQ ID NO: 2125 - RNA, 2244 nt, Artificial Sequence
  derived and/or modified CDS sequence (opt5) from MERS-CoV__ANC28678__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccaucugcagcauucagucugaucggaaggccugggcugccuucuauguuuacaaacugcagccgcucacauuucugcuggacuucuccguggauggguauauccgcagagcuaucgacuguggauuuaacgaucucagccaacugcauugcucuuacgagagcuucgacguggaauccggcgucuauucugugagcuccuuugaggccaagccuagcgggucuguuguggaacaggccgagggagucgagugugauuucagcccccuucuguccggcaccccuccccagguguacaacuuuaaacggcucguuuucacgaauugcaacuacaaucugacaaaacuucugucucucuucuccgugaacgacuuuaccuguagccaaauuucccccgcugcgaucgccucuaauugcuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaaguguucucgccuucugagcgaugggagaaccgaagucccucagcucgugaacgccaaucaauauucccccugcguuagcauugugccgucuacagucugggaggacggagacuacuaccggaaacagcuguccccucuggaaggcgggggauggcucguggcuagcggcuccaccguugccaugacagagcagcugcagaugggguuuggcaucaccgugcaauauggaacggauaccaacucugucugucccaaacuugaguucgcgaaugacacaaagauugcuagccagcugggcaacugcguggaauacucccucuauggggugucuggacgcggcguuuuucagaauuguaccgccgucggggugagacagcaacgguucguguacgaugccuaucagaaccuggucggauacuauagcgacgauggcaacuacuacugccugagagcuuguguguccguuccugugucugucaucuaugacaaggagacaaagacccaugccacgcuuuuugggagcguggcuugcgaacacauuuccagcacaaugucucaguacucccgcagcacccggucuaugcucaaaagacgcgauuccacauauggcccccugcagaccccuguuggaugugugcugggccucgucaauagcucucuguucguggaggacugcaaacuuccccuggggcaaucccucugugcccugccggauaccccuagcacacugacgcccuga

SEQ ID NO: 2126 - RNA, 2244 nt, Artificial Sequence
  derived and/or modified CDS sequence (opt5) from MERS-CoV__AHL18090__S1
augauccacagcguguuccugcucauguuucugcuuacccccacagaguccuacgucgacguuggccuggauucugccaagagcgcuugcauugaaguggacauccagcaaacguucuuugauaaaaccuggccuagaccgauugacguguccaaggccgaugggaucauuuauccccagggacggacauacucuaacaucaccaucacauaucagggccucuucccuuaccagggggaccauggagauauguaugucuacagcgcgggccacgcuaccgggacaacgccccaaaaacuguuuguggccaauuauucccaggacguuaagcaguucgccaacggauuugugguccgcauuggcgcugccgcuaauucuaccggcaccgugaucauuagcccuuccacaagcgccaccaucagaaaaauuuaccccgcguucaugcuugggucuuccguuggaaacuuuagcgauggcaagauggggcgguucuuuaaucauacacuggugcuccugccugacggauguggcacccugcuccgcgccuucuacugcauccuggagccgagaucugggaacuauugucccgcuggaaauuccuacacgagcuuugccacauaucacaccccugcuacagauugcucugacggcaacuacaaucggaacgccucccuuaauagcuucaaggaauauuucaaccugcgcaauuguaccuuuauguacaccuauaacauuacagaggaugaaauccucgagugguucggcaucacgcagaccgcgcaagggguccaucuguuuuccucuagauacguggaccuuuacggaggcaauauguuccaguuugccacacugcccguguaugacaccauuaaauacuauagcaucauuccucacuccauccggagcauucagucugaucgcaaggcuugggccgcuuucuacgucuauaaacuccagccccugacauuucugcucgacuucuccguugauggguacaucagacgggccaucgacugcggauuuaacgaucugagccaacuucacuguucuuaugagagcuucgacguggaauccggcguguacucugucagcuccuuugaggccaagccgagcgggucugugguugaacaggcugagggaguggagugcgauuucuccccucugcucagcggcacgcccccucaggucuacaacuuuaaacgccugguguucaccaauuguaacuauaaucuuacaaagcugcucucucuguucuccguuaacgacuuuaccugcagccaaauuucccccgcggccaucucuagcaauuguuacuccucucugauucucgauuauuucagcuacccccuguccaugaaaagcgaccuuucuguguccagcgcuggcccuaucucucaguuuaacuauaagcaguccuucagcaauccgaccugccugauucucgccacagucccccauaaccugaccacaaucacgaagccucuuaaauacucuuauaucaauaagugcagcagacugcucuccgaugaccggaccgaagugccccagcuggucaacgccaaucaauacagcccuugugugucuauuguucccuccacagugugggaggacggggauuacuaucgcaaacagcugagcccgcucgaaggaggcggguggcuggucgcuuccggaucuaccguggccaugacagagcagcuucagaugggcuuugggaucaccguucaauacggcacggacaccaacagcgugugcccuaagcuggaguucgcgaaugauacaaaaauugcuucccagcucggaaacugugucgaauauucucuguacggcgugagcgggagaggaguguuucagaauugcaccgccguuggcguccggcagcaaagauucguguaugacgccuaccagaaccuggugggguauuacuccgaugacggaaacuacuauugucuucgcgcuugcgucucugugcccguuagcgugaucuacgauaagaagacaaaaacccacgccacgcucuuuggcuccgucgcuugugagcauauuagcucuacaaugucccaguauagccggucuaccagauccacacugaagcgccgggacagcaccuacgggccucugcagacccccgugggcugcguucucggacuggucaauucuucccuuuucguggaagauuguaaacugccucucggccaaagccugugcgcccugcccgacacaccguccacgcuuaccccuuga

SEQ ID NO: 2127 - RNA, 2244 nt, Artificial Sequence
  derived and/or modified CDS sequence (opt5) from MERS-CoV__AHX00731__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugggcgucagcucugcugggccgaucucccaguuuaacuacaagcagagcuucucuaauccuaccugccuuauucuggccacagugccccacaaccucaccacaaucacgaagccccugaaauauuccuacaucaauaagugcagcagacuucugucugaugaccggaccgaagucccucagcucgugaacgccaaucaauauagccccuguguuuccauugugccgagcacagucugggaggacggagauuacuaccgcaaacagcugucuccucuggaaggcgggggauggcucguggcuuccggcagcaccguugccaugacagagcagcugcagaugggguuuggcaucaccgugcaauauggaacggacaccaacuccgucugccccaaacuugaauuugcgaaugauacaaagauugcuucucagcugggcaacuguguggaguacagccucuaugggguguccggaagaggcguuuuucagaauugcaccgccgucggggugcggcagcaaagauucguguacgacgccuaucagaaccuggucggauacuauucugaugacggcaacuacuacugucugcgcgcuugcgugagcguuccuguguccgucaucuaugauaaggagacaaagacccaugccacgcuuuuugggucuguggcuugugaacacauuagcuccacaaugagccaguacucucgguccaccagaagcaugcucaaacgccgggacucuacauauggcccccugcagaccccuguuggaugcgugcugggccucgucaauuccagccuguucguggaggauuguaaacuuccccuggggcaaucucucugcgcccugccggacaccccuuccacacugacgcccuga

SEQ ID NO: 2128 - RNA, 2244 nt, Artificial Sequence
  derived and/or modified CDS sequence (opt5) from MERS-CoV__AHX71946__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauucccauacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaccucuuuuccucuagauacguggaccuguauggaggcaauauguuccaguuugcgacacuuccugucuacgacaccauuaaauacuauagcaucauuccccauuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguauaacuuuaaacgccucguuuucacgaauuguaacuacaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuauuaccgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuauuacugucugcgcgcuugcguguccguuccugugucugucaucuacgauaaggagacaaagacccacgccacgcuuuuuggcagcguggcuugugaacacauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2129 - RNA, 2244 nt, Artificial Sequence
  derived and/or modified CDS sequence (opt5) from MERS-CoV__AHY22545__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaucgccucguuuucacgaacuguaauuacaaccugacaaaacuucugucucucuucuccgugaaugacuuuaccugcagccaaauuucccccgcugcgaucgccucuaacuguuauagcucccugauucuggauuacuucucuuauccucucagcaugaaguccgaccugagcgucucuuccgcuggcccgaucagccaguuuaauuacaagcagucuuucuccaacccuaccugccuuauucuggccacagugccccacaaucucaccacaaucacgaaaccccugaaguauagcuacaucaacaaaugcucuagacuucugagcgaugaccggaccgaagucccucagcucgugaaugccaaccaauauucccccuguguuagcauugugccgucuacagucugggaggacggggauuacuaccgcaagcagcuguccccucuggaaggaggcggguggcucguggcuagcggauccaccguugccaugacagagcagcugcagaugggcuuugggaucaccgugcaauauggcacggacaccaauucugucugccccaaacuugaguucgcgaacgauacaaagauugcuagccagcugggaaauuguguggaauacucccucuauggcgugucugggagaggaguuuuucagaacugcaccgccgucggcgugcggcagcaaagauucguguacgacgccuaucagaaccuggucggguacuauagcgaugacggaaauuacuacugucugcgcgcuugcguguccguuccugugucugucaucuaugauaaagagacaaagacccaugccacgcuuuuuggcagcguggcuugugaacacauuuccagcacaaugucucaguacucccggagcaccagaucuaugcucaagcgccgggacuccacauaugggccccugcagaccccuguuggcugcgugcugggacucgucaacagcucucuguucguggaggauuguaaacuuccccugggccaaucccucugcgcccugccggacaccccuagcacacugacgcccuga

SEQ ID NO: 2130 - RNA, 2244 nt, Artificial Sequence
  derived and/or modified CDS sequence (opt5) from MERS-CoV__AHY22555__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaauuacacacuuguccugcucccggacggauguggcacccugcugcgcgcguucuauugcauccucgagcccagaucugggaaccauuguccugccggaaauuccuacacgagcuuugcuacauaucacacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcuuccuucuacguuuauaaacugcagccgcucacauuucugcuggacuucagcguggauggguacaucagacgggccaucgacugcggauuuaacgaucucucucaacugcacuguagcuaugaguccuucgacguggaaucuggcgucuacagcguguccagcuuugaggcuaagccuucuggguccguuguggaacaggccgagggagucgagugcgauuucagcccccuucugucuggcaccccuccccagguguacaacuuuaaacgccucguuuucacgaauuguaacuauaaucugacaaaacuucugucccucuucagcgugaacgacuuuaccugcucccaaauuucucccgccgcuaucgcgagcaauuguuacuccucucugauucuggauuauuucagcuacccucucuccaugaaaagcgaccugucugucuccagcgccggcccgaucucucaguuuaacuauaagcaguccuucagcaauccuaccugccuuauucuggcuacagugccccauaaccucaccacaaucacgaagccccugaaguacucuuauaucaauaagugcagcagacuucuguccgaugaccggaccgaagucccucagcucgugaacagcaaucaauacucucccuguguuuccauugugccgagcacagucugggaggacggggauuacuaucgcaaacagcuguccccucuggaaggaggcggguggcucguggccucuggaagcaccguugccaugacagagcagcugcagaugggcuuugggaucaccgugcaauacggcacggacaccaacuccgucugccccaaacuugaguucgcuaaugauacaaagauugccucucagcugggaaacuguguggaauauagccucuacggcguguccgggagaggaguuuuucagaauugcaccgcggucggcgugcggcagcaaagauucguguaugacgcuuaccagaaccuggucggguauuacucugaugacggaaacuacuauugucugcgcgccugcgugagcguuccuguguccgucaucuacgauaaggagacaaagacccacgccacgcuuuuuggcagcguggcuugugaacauauuucuuccacaaugagccaguauucucgguccaccagaagcaugcucaaacgccgggacucuacauacgggccccugcagaccccuguuggcugcgugcugggacucgucaauuccagccuguucguggaggauuguaaacuuccccugggccaaucccucugcgcccugccggacaccccuagcacacugacgcccuga

SEQ ID NO: 2131 - RNA, 2244 nt, Artificial Sequence
  derived and/or modified CDS sequence (opt5) from MERS-CoV__AHY22565__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaucauuagaaaaaucuacccugccuucaugcuggggucuuccgugggaaacuuuagcgauggcaagauggggcgguucuuuaaucauacccuuguccugcucccggacggauguggcacacugcugcgcgcguucuacugcauucucgagcccagaucugggaaccacuguccugccggaaauuccuauaccagcuuugcuacguaccauacacccgccaccgauugcucugacggcaacuauaaucggaacgcuucccugaauagcuucaaggaauacuucaaccuucgcaauuguacauuuauguauaccuacaacaucaccgaggaugaaauccuggagugguucggcauuacacagacggcccaaggggugcaccucuuuuccucuagauauguggaccuguacggaggcaauauguuccaguuugcgacccuuccugucuacgacacaaucaaauauuacagcauuaucccccacuccauucggagcauccagucugaucgcaaggccugggcuuccuucuauguuuacaaacugcagccgcucaccuuucugcuggacuucagcguggauggguauaucagacgggccauugacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcacaccuccccagguguacaacuuuaaacgccucguuuucaccaauuguaacuacaaucugacgaaacuucugucccucuucagcgugaacgacuuuacaugcucccaaaucucucccgccgcuauugcgagcaauuguuauuccucucugauccuggauuacuucagcuauccucucuccaugaaaagcgaccugucugucuccagcgccggcccgauuucucaguuuaacuacaagcaguccuucagcaauccuaccugccuuauccuggcuaccgugccccacaaccucacaaccaucacaaagccccugaaguauucuuacauuaauaagugcagcagacuucuguccgaugaccggacggaagucccucagcucgugaacgccaaucaauauagccccuguguuucuaucgugccguccaccgucugggaggacggggauuacuaccgcaaacagcugagcccucuggaaggaggcggguggcucguggccuccggaucuacaguugcuaugaccgagcagcugcagaugggcuuugggauuacagugcaauauggcaccgacacgaacagcgucugccccaaacuugaguucgccaaugauaccaagaucgcgucccagcugggaaacuguguggaauacucucucuauggcgugagcgggagaggaguuuuucagaauugcacagcugucggcgugcggcagcaaagauucguguacgacgccuaucagaaccuggucggguacuauuccgaugacggaaacuacuacugucugcgcgccugcgugucuguuccugugagcgucauuuaugauaaggagaccaagacacaugcuacccuuuuuggcuccguggccugugaacacaucagcucuacgaugucccaguacagccggucuacaagauccaugcucaaacgccgggacagcaccuaugggccccugcagacaccuguuggcugcgugcugggacucgucaauucuucccuguucguggaggauuguaaacuuccccugggccaaagccucugcgcucugccggacaccccuuccacccugacacccuga

SEQ ID NO: 2132 - RNA, 2244 nt, Artificial Sequence
  derived and/or modified CDS sequence (opt5) from MERS-CoV__AJG44069__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucgcaaacucuuuguugcuaauuauucccaagacgugaagcaguucgccaacggauuugucgugagaauuggcgccgcugccaauucuacgggcaccguuaucauuagccccuccacaagcgcuaccauccggaaaauuuacccugccuucaugcuggggucuuccgugggaaacuuuagcgauggcaagauggggcgcuucuuuaaucauacacuuguccugcucccggacggauguggcacccugcugagagcguucuacugcauccucgagccccggucugggaaccacuguccugccggaaauuccuauacgagcuuugcuacauaccauacccccgccacagauugcucugacggcaacuauaaucgcaacgcuucccugaauagcuucaaggaauacuucaaccuuagaaauuguaccuuuauguauaccuacaacauuacagaggaugaaauccuggagugguucggcaucacgcagaccgcccagggggugcaccucuuuuccucucgguauguggaccuguacggaggcaauauguuccaauuugcgacacuuccugucuacgacaccauuaaauauuacagcaucauuccccacuccauccgcagcauucagucugauagaaaggccugggcugccuucuauguuuacaaacugcagccgcucacauuucugcuggacuucuccguggauggguauauccggcgcgcuaucgacugcggauuuaacgaucucagccagcugcauuguucuuacgagagcuucgacguggaauccggcgucuauucugugagcuccuuugaggccaagccuagcgggucuguuguggaacaagccgagggagucgagugcgauuucagcccccuucuguccggcaccccuccccagguguacaacuuuaaaagacucguuuucacgaauuguaacuacaaucugacaaagcuccugucucucuucuccgugaacgacuuuaccugcagccagauuucccccgcugcgaucgccucuaauuguuauagcucccugauucuggauuacuucucuuauccucucagcaugaaguccgaccugagcgucucuuccgcuggcccgaucagccaauuuaacuacaaacagucuuucuccaauccuaccugccuuauucuggccacagugccccacaaccucaccacaaucacgaagccccugaaauauagcuacaucaauaagugcucucggcuucugagcgaugaccgcaccgaagucccucagcucgugaacgccaaucaguauucccccuguguuagcauugugccgucuacagucugggaggacggggauuacuacagaaaacaacuguccccucuggaaggaggcggguggcucguggcuagcggauccaccguugccaugacagagcagcugcagaugggcuuugggaucaccgugcaguauggcacggacaccaacucugucugccccaaacuugaguucgcgaaugauacaaagauugcuagccaacugggaaacuguguggaauacucccucuauggcgugucugggcggggaguuuuucagaauugcaccgccgucggcgugagacagcagcgcuucguguacgacgccuaucaaaaccuggucggguacuauagcgaugacggaaacuacuacugucugcgggcuugcguguccguuccugugucugucaucuaugauaaggagacaaagacccaugccacgcuuuuuggcagcguggcuugugaacacauuuccagcacaaugucucaguacuccagaagcacccgcucuaugcucaaacggagagacuccacauaugggccccugcagaccccuguuggcugcgugcugggacucgucaauagcucucuguucguggaggauuguaaacuuccccugggccagucccucugcgcccugccggacaccccuagcccccugacacccuga

SEQ ID NO: 2133 - RNA, 2244 nt, Artificial Sequence
  derived and/or modified CDS sequence (opt5) from MERS-CoV__AJG44080__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauuaagucugaucgcaaagccugggcugccuucuauguuuacaagcugcagccgcucacauuucugcuggacuucuccguggauggguauaucagacgggcuaucgacugcggauuuaacgaucucagccagcugcauuguucuuacgagagcuucgacguggaauccggcgucuauucugugagcuccuuugaggccaaaccuagcgggucuguuguggaacaagccgagggagucgagugcgauuucagcccccuucugagcggcaccccuccccagguguacaacuuuaagcgccucguuuucacgaauuguaacuacaaucugacaaagcuccugucucucuucuccgugaacgacuuuaccugcagccagauuucccccgcugcgaucgccucuaauuguuauagcucccugauucuggauuacuucucuuauccucucagcaugaaauccgaccugagcgucucuuccgcuggcccgaucagccaauuuaacuacaagcagucuuucuccaauccuaccugccuuauucuggccacagugccccacaaccucaccacaaucacgaaaccccugaaguauagcuacaucaauaaaugcucuagacuucugagcgaugaccggaccgaagucccucagcucgugaacgccaaucaguauucccccuguguuagcauugugccgucuacagucugggaggacggggauuacuaccgcaagcaacuguccccucuggaaggaggcggguggcucguggcuagcggauccaccguugccaugacagagcagcugcagaugggcuuugggaucaccgugcaguauggcacggacaccaacucugucugccccaaacuugaguucgcgaaugauacaaagauugcuagccaacugggaaacuguguggaauacucccucuauggcgugucugggagaggaguuuuucagaauugcaccgccgucggcgugcggcagcagagauucguguacgacgccuaucaaaaccuggucggguacuauagcgaugacggaaacuacuacugucugcgcgcuugcguguccguuccugugucugucaucuaugauaaggagacaaaaacccaugccacgcuuuuuggcagcguggcuugugaacacauuuccagcacaaugucucaguacucccggagcaccagaucuaugcucaagcgccgggacuccacauaugggccccugcagaccccuguuggcugcgugcugggacucgucaauagcucucuguucguggaggauuguaaacuuccccugggccagucccucugcgcccugccggacaccccuagcccccugacacccuga

SEQ ID NO: 2134 - RNA, 2244 nt, Artificial Sequence
  derived and/or modified CDS sequence (opt5) from MERS-CoV__AJG44102__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaagcuccugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaaacagucuuucuccaauccuaccugccuuauucuggccacagugagccacaaccucaccacaaucacgaagccccugaaauauucuuacaucaauaagugcagcagacuucuguccgaugaccggaccgaagucccccagcucgugaacgccaaucaauauagcccuuguguuucuauugugcccuccacagucugggaggacggggauuacuaccgcaaacagcugagcccgcuggaaggaggcggguggcucguggcuuccggaucuaccguugccaugacagagcagcugcagaugggcuuugggaucaccgugcaauauggcacggacaccaacagcgucugcccuaaacuugaguucgcgaaugauacaaagauugcuucccagcugggaaacuguguggaauacucucucuauggcgugagcgggagaggaguuuuucagaauugcaccgccgucggcgugcggcagcaaagauucguguacgacgccuaucagaaccuggucggguacuauuccgaugacggaaacuacuacugucugcgcgcuugcgugucuguucccgugagcgucaucuaugauaaggagacaaagacccaugccacgcuuuuuggcuccguggcuugugaacacauuagcucuacaaucucccaguacagccggucuaccagauccaugcucaaacgccgggacagcacauaugggccucugcagacccccguuggcugcgugcugggacucgucaauucuucccuguucguggaggauuguaaacuuccucugggccaaagccucugcgcccugcccgacaccccguccacacugacgccuuga

SEQ ID NO: 2135 - RNA, 2244 nt, Artificial Sequence
  derived and/or modified CDS sequence (opt5) from MERS-CoV__AJG44124__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaauguuccaguacucucgguccaccagaagcaugcucaaacgccgggacucuacauaugggccccugcagaccccuguuggcugcgugcugggacucgucaauuccagccuguuuguggaggauuguaaacuuccccugggccaaucucucugcgcccugccggacaccccuuccacacugacgcccuga

SEQ ID NO: 2136 - RNA, 2244 nt, Artificial Sequence
  derived and/or modified CDS sequence (opt5) from MERS-CoV__ALL26396__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguccguggaggauuguaaacuuccccugggccaaagccucugcgcccugccggacaccccuuccacacugacgcccuga

SEQ ID NO: 2137 - RNA, 2244 nt, Artificial Sequence
  derived and/or modified CDS sequence (opt5) from MERS-CoV__ALS20350__S1
augauccacagcguguuccugcucauguuucugcuuacccccacagaguccuacgucgacguuggcccugauucugccaagagcgcuugcauugaaguggacauccagcaaacguucuuugauaaaaccuggccgagacccauugacguguccaaggccgaugggaucauuuauccucagggacggacauacucuaacaucaccaucacauaucagggccuguuccccuaccagggggaccauggagauauguaugucuacagcgcgggccacgcuaccgggacaaccccucaaaaacucuuuguggccaauuauucccaggacguuaagcaguucgccaacggauuugugguccgcauuggcgcugccgcuaauucuacgggcaccgugaucauuagccccuccacaagcgccaccaucagaaaaauuuacccugcguucaugcuggggucuuccguuggaaacuuuagcgauggcaagauggggcgguucuuuaaucauacacuugugcugcucccggacggauguggcacccugcugcgcgccuucuacugcauccucgagcccagaucugggaacuauuguccugcuggaaauuccuacacgagcuuugccacauaucacacccccgcuacagauugcucugacggcaacuacaaucggaacgccucccugaauagcuucaaggaauauuucaaccuucgcaauuguaccuuuauguacaccuauaacauuacagaggaugaaauccuggagugguucggcaucacgcagaccgcgcaagggguccaucucuuuuccucuagauacguggaccuguacggaggcaauauguuccaguuugccacacuuccuguguaugacaccauuaaauacuauagcaucauuccccacuccauccggagcauucagucugaucgcaaggcuugggccgcuuucuacgucuauaaacugcagccgcucacauuucugcuggacuucuccguugauggguacaucagacgggccaucgacugcggauuuaacgaucucagccaacugcacuguucuuaugagagcuucgacguggaauccggcguguacucugucagcuccuuugaggccaagccuagcgggucugugguugaacaggcugagggaguggagugcgauuucagcccccuucugagcggcaccccuccccaggucuacaacuuuaaacgccucguguucacgaauuguaacuauaaucugacaaaacuucugucucucuucuccguuaacgacuuuaccugcagccaaauuucccccgcggccaucgcuucuaauuguuacagcucccugauucuggauuauuucucuuacccucucagcaugaaguccgaccugagcgugucuuccgccggcccgaucagccaguuuaacuauaagcagucuuucuccaauccuaccugccuuauucuggccacagucccccauaaccucaccacaaucacgaagccccugaaauacagcuauaucaauaagugcucuagacuucugagcgaugaccggaccgaagugccucagcucgucaacgcuaaucaauacucccccugugugagcauuguuccgucuacagugugggaggacggggauuacuaucgcaaacagcuguccccucuggaaggaggcggguggcucgucgccagcggauccaccguggcgaugacagagcagcugcagaugggcuuugggaucaccguucaauacggcacggacaccaacucugugugccccaaacuugaguucgcuaaugauacaaagauugccagccagcugggaaacugugucgaauauucccucuacggcgugucugggagaggaguguuucagaauugcaccgccguuggcguccggcagcaaagauucguguaugacgcuuaccagaaccuggugggguauuacagcgaugacggaaacuacuauugucugcgcgccugcgucacagugccuguuuccgugaucuacgauaaggagaccaagacgcacgcuacacuuuuuggcucugucgccugugaacauauuagcuccaccaugagccaguauucucgguccacaagaagcaugcucaaacgccgggacucuaccuacgggccccugcagaccccugugggcugcguucugggacucgucaauuccagccuguucguggaggauuguaaacuuccccugggccaaucucucugcgcgcugccggacacaccuuccacgcugacccccuga

SEQ ID NO: 2138 - RNA, 2244 nt, Artificial Sequence; identical to SEQ ID NO: 2058
  derived and/or modified CDS sequence (opt5) from MERS-CoV__ALT66880__S1

SEQ ID NO: 2139 - RNA, 2244 nt, Artificial Sequence
  derived and/or modified CDS sequence (opt5) from MERS-CoV__ALA49341__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaacccuccaaaaacuguuuguugcuaauuauucccaggacgugaagcaguucgccaacggauuugucgugcgcauuggcgccgcugccaauucuacgggcaccguuaucauuagcccuuccacaagcgcuaccaucagaaaaauuuaccccgccuucaugcuugggucuuccgugggaaacuuuagcgauggcaagauggggcgguucuuuaaucauacacugguccuccugccugacggauguggcacccugcuccgcgcguucuacugcauccuggagccgagaucugggaaccacugucccgccggaaauuccuauacgagcuuugcuacauaccauaccccugccacagauugcucugacggcaacuauaaucggaacgcuucccuuaauagcuucaaggaauacuucaaccugcgcaauuguaccuuuauguauaccuacaacauuacagaggaugaaauccucgagugguucggcaucacgcagaccgcccaaggggugcaccuguuuuccucuagauauguggaccuuuacggaggcaauauguuccaguuugcgacacugcccgucuacgacaccauuaaauauuacagcaucauuccucacuccauccggagcauucagucugaucgcaaggccugggcugccuucuauguuuacaaacuccagccccugacauuucugcucgacuucuccguggauggguauaucagacgggcuaucgacugcggauuuaacgaucugagccaacuucauuguucuuacgagagcuucgacguggaauccggcgucuauucugugagcuccuuugaggccaagccgagcgggucuguuguggaacaggccgagggagucgagugcgauuucuccccucugcucagcggcacgcccccucagguguacaacuuuaaacgccugguuuucaccaauuguaacuacaaucuuacaaagcugcucucucuguucuccgugaacgacuuuauuugcagccaaaucucccccgcugcgauugccucuaauuguuauagcucccugauccucgauuacuucucuuauccccugagcaugaaguccgaccuuagcgucucuuccgcuggcccuauuagccaguuuaacuacaaacagucuuucuccaauccgaccugccugauccucgccaccgugccccacaaccugacaaccaucacaaagccucuuaaauauagcuacauuaauaagugcucuagacugcucagcgaugaccggacggaagucccccagcuggugaacgccaaucaauauuccccuuguguuagcaucgugcccucuaccgucugggaggacggggauuacuaccgcaaacagcuguccccgcucgaaggaggcggguggcugguggcuagcggauccacaguugccaugaccgagcagcuucagaugggcuuugggauuacagugcaauauggcaccgacacgaacucugucugcccuaagcuggaguucgcgaaugauaccaaaaucgcuagccagcucggaaacuguguggaauacucccuguauggcgugucugggagaggaguuuuucagaauugcacagccgucggcgugcggcagcaaagauucguguacgacgccuaucagaaccuggucggguacuauagcgaugacggaaacuacuacugucuucgcgcuugcguguccguucccgugucugucauuuaugauaaggagaccaagacacaugccacccucuuuggcagcguggcuugugaacacaucuccagcacgaugucucaguacucccggagcacaagaucuaugcugaaacgccgggacuccaccuaugggccucugcagacacccguuggcugcgugcucggacuggucaauagcucucuuuucguggaggauuguaagcugccucucggccaaucccugugcgcccugcccgacaccccgagcacccuuacaccuuga

SEQ ID NO: 2140 - RNA, 2244 nt, Artificial Sequence
  derived and/or modified CDS sequence (opt5) from MERS-CoV__ALA49352__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauacuauacccccgccacagauugcucugacggcaacuacaaucggaacgcuucccugaauagcuucaaggaauauuucaaccuucgcaauuguaccuuuauguacaccuauaacauuacagaggaugaaauccuggagugguucggcaucacgcagaccgcccaaggggugcaucucuuuuccucuagauacguggaccuguacggaggcaauauguuccaguuugcgacacuuccugucuaugacaccauuaaauacuauagcaucauuccccacuccauccggagcauucagucugaucgcaaggccugggcugccuucuacguuuauaaacugcagccgcucacauuucugcuggacuucuccguggauggguacaucagacgggcuaucgacugcggauuuaacgaucucagccaacugcacuguucuuaugagagcuucgacguggaauccggcgucuacucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuauaaucugacaaaacuucugucucucuucuccgugaacgacuuuaccugcagccaaauuucccccgcugcgaucgccucuaauuguuacagcucccugauucuggauuauuucucuuacccucucagcaugaaguccgaccugagcgucucuuccgcuggcccgaucagccaguuuaacuauaagcagucuuucuccaauccuaccugccuuauucuggccacagugccccauaaccucaccacaaucacgaagccccugaaauacagcuauaucaauaagugcucuagacuucugagcgaugaccggaccgaagucccucagcucgugaacgccaaucaauacucccccuguguuagcauugugccgucuacagucugggaggacggggauuacuaucgcaaacagcuguccccucuggaaggaggcggguggcucguggcuagcggauccaccguugccaugacagagcagcugcagaugggcuuugggaucaccgugcaauacggcacggacaccaacucugucugccccaaacuugaguucgcgaaugauacaaagauugcuagccagcugggaaacuguguggaauauucccucuacggcgugucugggagaggaguuuuucagaauugcaccgccgucggcgugcggcagcaaagauucguguaugacgccuaccagaaccuggucggguauuacagcgaugacggaaacuacuauugucugcgcgcuugcguguccguuccugugucugucaucuacgauaaggagacaaagacccacgccacgcuuuuuggcagcguggcuugugaacauauuuccagcacaaugucucaguauucccggagcaccagaucuaugcucaaacgccgggacuccacauacgggccccugcagaccccuguuggcugcgugcugggacucgucaauagcucucuguucguggaggauuguaaacuuccccugggccaaucccucugcgcccugccggacaccccuagcacacugacgcccuga

SEQ ID NO: 2141 - RNA, 2244 nt, Artificial Sequence
  derived and/or modified CDS sequence (opt5) from MERS-CoV__ALA49363__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacauucccugucuacgacaccauuaaauauuacagcaucauuccccacuccauccggagcauucagucugaucgcaaggccugggcugccuuuuauguuuacaaacuucagccgcugacauuccuccuggacuuuuccguggauggguauaucagacgggcuaucgacugcggauucaacgaucugagccaacuccauuguucuuacgagagcuuugacguggaauccggcgucuauucugugagcuccuucgaggccaagccuagcgggucuguuguggaacaggccgagggagucgagugcgauuuuagcccccugcuuagcggcaccccuccccagguguacaacuucaaacgccugguuuucacgaauuguaacuacaaucucacaaagcugcuuucucuguuuuccgugaacgacuuuaccugcagccaaauuucccccgcugcgaucgccucuaauuguuauagcucccucauucuggauuacuucucuuauccucugagcaugaaguccgaccucagcgucucuuccgcuggcccgaucagccaguucaacuacaaacagucuuuuuccaauccuaccugccugauucuugccacagugccccacaaccugaccacaaucacgaagccccucaaauauagcuacaucaauaagugcucuagacugcuuagcgaugaccggaccgaagucccucagcuggugaacgccaaucaauauucccccuguguuagcauugugccgucuacagucugggaggacggggauuacuaccgcaaacagcucuccccucuggaaggaggcggguggcugguggcuagcggauccaccguugccaugacagagcagcuccagaugggcuucgggaucaccgugcaauauggcacggacaccaacucugucugccccaagcuggaauuugcgaaugauacaaaaauugcuagccagcuuggaaacuguguggaguacucccuguauggcgugucugggagaggaguuuuccagaauugcaccgccgucggcgugcggcagcaaagauuuguguacgacgccuaucagaaccucgucggguacuauagcgaugacggaaacuacuacugucugcgcgcuugcguguccguuccugugucugucaucuaugauaaggagacaaagacccaugccacgcuguucggcagcguggcuugugaacacauuuccagcacaaugucucaguacucccggagcaccagaucuaugcuuaaacgccgggacuccacauaugggccccuccagaccccuguuggcugcgugcugggacuggucaauagcucucucuuuguggaggauuguaagcugccccuuggccaaucccugugcgcccucccggacaccccuagcacacugacgcccuga

SEQ ID NO: 2142 - RNA, 2244 nt, Artificial Sequence; identical to SEQ ID NO: 2074
  derived and/or modified CDS sequence (opt5) from MERS-CoV__ALA49374__S1

SEQ ID NO: 2143 - RNA, 2244 nt, Artificial Sequence
  derived and/or modified CDS sequence (opt5) from MERS-CoV__ALA49396__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuccagcaauccuaccugccuuauucuggccacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggcuuccggaucuaccguugccaugacagagcagcugcagaugggcuucgggaucaccgugcaauauggcacggacaccaacagcgucugccccaaacuugaauuugcgaaugauacaaagauugcuucccagcugggaaacuguguggaguacucucucuauggcgugagcgggagaggaguuuuccagaauugcaccgccgucggcgugcggcagcaaagauuuguguacgacgccuaucagaaccuggucggguacuauuccgaugacggaaacuacuacugucugcgcgcuugcgugucuguuccugugagcgucaucuaugauaaggagacaaagacccaugccacgcuuuucggcuccguggcuugugaacacauuagcucuacaaugucccaguacagccggucuaccagauccaugcucaaacgccgggacagcacauaugggccccugcagaccccuguuggcugcgugcugggacucgucaauucuucccuguuuguggaggauuguaaacuuccccugggccaaagccucugcgcccugccggacaccccuuccacacugacgcccuga

SEQ ID NO: 2144 - RNA, 2244 nt, Artificial Sequence
  derived and/or modified CDS sequence (opt5) from MERS-CoV__ALA49451__S1
augauccacagcguguuccugcucauguuucugcuuacccccacagaguccuacgucgacguuggcccugauucugugaaguccgccugcauugaaguggacauccagcaaacguucuuugauaaaaccuggccgagacccauugacgucuccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucugagcggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccgcuggcccgaucagccaguuuaacuacaagcagucuuucuccaauccuaccugccuuauucuggccacagugccccacaaccucaccacaaucacgaagccccugaaauauagcuacaucaauaagugcucuagacuucugagcgaugaccggaccgaagucccucagcucgugaacgccaaucaauauucccccuguguuagcauugugccgucuacagucugggaggacggggauuacuaccgcaaacagcuguccccucuggaaggaggcggguggcucguggcuagcggauccaccguugccaugacagagcagcugcagaugggcuuugggaucaccgugcaauauggcacggacaccaacucugucugccccaaacuugaguucgcgaaugauacaaagauugcuagccagcugggaaacuguguggaauacucccucuauggcgugucugggagaggaguuuuucagaauugcaccgccgucggcgugcggcagcaaagauucguguacgacgccuaucagaaccuggucggguacuauagcgaugacggaaacuacuacugucugcgcgcuugcguguccguuccugugucugucaucuaugauaaggagacaaagacccaugccacgcuuuuuggcagcguggcuugugaacacauuuccagcacaaugucucaguacucccggagcaccagaucuaugcucaaacgccgggacuccacauaugggccccugcagaccccuguuggcugcgugcugggacucgucaauagcucucuguucguggaggauuguaaccuuccccugggccaaucccucugcgcccugccggacaccccuagcacacugacgcccuga

SEQ ID NO: 2145 - RNA, 2244 nt, Artificial Sequence
  derived and/or modified CDS sequence (opt5) from MERS-CoV__ALA49473__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccacaaccgauugcucugacggcaacuauaaucggaacgccucccugaauagcuucaaggaauacuucaaccuucgcaauuguaccuuuauguauacauacaacauuacggaggaugaaauccuggagugguucggcaucacccagacagcucaaggggugcaccucuuuuccucuagauauguggaccuguacggaggcaauauguuccaguuugccacccuuccugucuacgacacaauuaaauauuacagcaucauuccccacuccauccggagcauucagucugaucgcaaggcgugggccgcuuucuauguuuacaaacugcagccgcucaccuuucugcuggacuucuccguggauggguauaucagacgggccaucgacugcggauuuaacgaucucagccaacugcauuguucuuacgagagcuucgacguggaauccggcgucuauucugugagcuccuuugaggcuaagccuagcgggucuguuguggaacaggccgagggagucgagugcgauuucagcccccuucuguccggcacgccuccccagguguacaacuuuaaacgccucguuuucacaaauuguaacuacaaucugaccaaacuucugucucucuucuccgugaacgacuuuaccugcagccaaauuucccccgccgcuaucgcgucuaauuguuauagcucccugauucuggauuacuucucuuauccucucagcaugaaguccgaccugagcgucucuuccgccggcccgaucagccaguuuaacuacaagcagucuuucuccaaucccacaugccuuauucuggcuaccgugccucacaaccucacaacgaucaccaagccccugaaauauagcuacaucaauaagugcucuagacuucugagcgaugaccggacagaagucccucagcucgugaacgccaaucaauauucccccuguguuagcauugugccgucuaccgucugggaggacggggauuacuaccgcaaacagcuguccccucuggaaggaggcggguggcucguggccagcggauccacaguugcuaugaccgagcagcugcagaugggcuuugggaucacggugcaauauggcaccgacacaaacucugucugccccaaacuugaguucgccaaugauaccaagauugcgagccagcugggaaacuguguggaauacucccucuauggcgugucugggagaggaguuuuucagaauugcacagcugucggcgugcggcagcaaagauucguguacgacgccuaucagaaccuggucggguacuauagcgaugacggaaacuacuacugucugcgcgccugcguguccguuccugugucugucaucuaugauaaggagaccaagacgcaugcuacacuuuuuggcagcguggccugugaacacauuuccagcaccaugucucaguacucccggagcacaagaucuaugcucaaacgccgggacuccaccuaugggccccugcagaccccuguuggcugcgugcugggacucgucaauagcucucuguucguggaggauuguaaacuuccccugggccaaucccucugcgcucugccggacacaccuagcacgcugacccccuga

SEQ ID NO: 2146 - RNA, 2244 nt, Artificial Sequence; identical to SEQ ID NO: 2058
  derived and/or modified CDS sequence (opt5) from MERS-CoV__ALA49583__S1

SEQ ID NO: 2147 - RNA, 2244 nt, Artificial Sequence
  derived and/or modified CDS sequence (opt5) from MERS-CoV__ALA49649__S1
augauccacagcguguuccugcucauguuucugcuuacccccacagaguccuacgucgacguuggcccugauucugucaagagcgccugcauugaaguggacauccagcagacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccuaaaaagcucuuuguugcuaauuauucccaagacgugaaacaguucgccaacggauuugucgugcgcauuggcgccgcugccaauucuacgggcaccguuaucauuagccccuccacaagcgcuaccaucagaaagauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaagaauacuucaaccuucgcaauuguaccuuuauguauaccuacaacauuacagaggaugaaauccuggagugguucggcaucacgcagaccgcccagggggugcaccucuuuuccucuagauauguggaccuguacggaggcaauauguuccaauuugcgacacuuccugucuacgacaccauuaaguauuacagcaucauuccccacuccauccggagcauucagucugaucgcaaagccugggcugccuucuauguuuacaagcugcagccgcucacauuucugcuggacuucuccguggauggguauaucagacgggcuaucgacugcggauuuaacgaucucagccagcugcauuguucuuacgagagcuucgacguggaauccggcgucuauucugugagcuccuuugaggccauuccuagcgggucuguuguggaacaagccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccagaucucccccgcugcgauugccucuaauuguuauagcucccugauccuggauuacuucucuuauccucucagcaugaaguccgaccugagcgucucuuccgcuggcccgauuagccaauuuaacuacaagcagucuuucuccaauccuaccugccuuauccuggccacagugccccacaaccucaccacaaucacgaagccccugaaauauagcuacauuaauaagugcucuagacuucugagcgaugaccggaccgaagucccucagcucgugaacgccaaucaguauucccccuguguuagcaucgugccgucuacagucugggaggacggggauuacuaccgcaaacaacuguccccucuggaaggaggcggguggcucguggcuagcggauccaccguugccaugacagagcagcugcagaugggcuuugggauuaccgugcaguauggcacggacaccaacucugucugccccaaacuugaguucgcgaaugauacaaagaucgcuagccaacugggaaacuguguggaauacucccucuauggcgugucugggagaggaguuuuucagaauugcaccgccgucggcgugcggcagcagagauucguguacgacgccuaucauaaccuggucggguacuauagcgaugacggaaacuacuacugucugcgcgcuugcguguccguuccugugucugucauuuaugauaaggagacaaagacccacgccacgcuuuuuggcagcguggcuugugaacacaucuccagcacaaugucucaauacucccggagcaccagaucuaugcucaaacgccgggacuccacauaugggccccugcagaccccuguuggcugcgugcugggacucgucaauagcucucuguucguggaggauuguaaacuuccccugggccagucccucugcgcccugccggacaccccuagcacacugacgcccuga

SEQ ID NO: 2148 - RNA, 2244 nt, Artificial Sequence
  derived and/or modified CDS sequence (opt5) from MERS-CoV__ALA49660__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaauucuacccugccuuuaugcuggggucuuccgugggaaacuucagcgauggcaagauggggcgguuuuucaaucauacacuuguccugcucccggacggauguggcacccugcugcgcgcguuuuacugcauucucgagcccagaucugggaaccacuguccugccggaaauuccuauacgagcuucgcuacauaccauacccccgccacagauugcucugacggcaacuauaaucggaacgcuucccugaauagcuucaaggaauacuuuaaccuucgcaauuguaccuucauguauaccuacaacaucacagaggaugaaauucuggagugguuuggcaucacgcagaccgcccaaggggugcaccucuucuccucuagauauguggaccuguacggaggcaauauguuucaguucgcgacacuuccugucuacgacaccaucaaauauuacagcauuaucccccacuccauucggagcauccagucugaucgcaaggccugggcugccuuuuauguuuacaaacugcagccgcucacauuccugcuggacuuuuccguggauggguauauuagacgggcuaucgacugcggauucaacgaucucagccaacugcauuguucuuacgagagcuuugacguggaauccggcgucuauucugugagcuccuucgaggccaagccuagcgggucuguuguggaacaggccgagggagucgagugcgauuuuagcccccuucuguccggcaccccuccccagguguacaacuucaaacgccucguuuucacgaauuguaacuacaaucugacaaaacuucugucucucuuuuccgugaacgacuuuaccugcagccaaaucucccccgcugcgauugccucuaauuguuauagcucccugauccuggauuacuuuucuuauccucucagcaugaaguccgaccugagcgucucuuccgcuggcccgauuagccaguucaacuacaagcagucuuuuuccaauccuaccugccuuauccuggccacagugccccacaaccucaccacaauuacgaagccccugaaauauagcuacaucaauaagugcucuagacuucugagcgaugaccggaccgaagucccucagcucgugaacgccaaucaauauucccccuguguuagcaucgugccgucuacagucugggaggacggggauuacuaccgcaaacagcuguccccucuggaaggaggcggguggcucguggcuagcggauccaccguugccaugacagagcagcugcagaugggcuucgggauuaccgugcaauauggcacggacaccaacucugucugccccaaacuugaauuugcgaaugauacaaagaucgcuagccagcugggaaacuguguggaguacucccucuauggcgugucugggagaggaguuuuccagaauugcaccgccgucggcgugcggcagcaaagauuuguguacgacgccuaucagaaccuggucggguacuauagcgaugacggaaacuacuacugucugcgcgcuugcguguccguuccugugucugucauuuaugauaaggagacaaagacccaugccacgcuuuucggcagcguggcuugugaacacaucuccagcacaaugucucaguacucccggagcaccagaucuaugcucaaacgccgggacuccacauaugggccccugcagaccccuguuggcugcgugcugggacucgucaauagcucucuguuuguggaggauuguaaacuuccccugggccaaucccucugcgcccugccggacaccccuagcacacugacgcccuga

SEQ ID NO: 2149 - RNA, 2244 nt, Artificial Sequence
  derived and/or modified CDS sequence (opt5) from MERS-CoV__ALA49671__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacaaacugcucugauggcaauuauaaccggaaugcuucccugaacagcuucaaggaauacuucaaucuucgcaacuguaccuuuauguauaccuacaauauuacagaggacgaaauccuggagugguucggcaucacgcagaccgcccaaggggugcaccucuuuuccucuagauauguggaucuguacggaggcaacauguuccaguuugcgacacuuccugucuacgacaccauuaaauauuacagcaucauuccccacuccauccggagcauucagucugaccgcaaggccugggcugccuucuauguuuacaaacugcagccgcucacauuucugcuggauuucuccguggacggguauaucagacgggcuaucgauugcggauuuaacgaccucagccaacugcauuguucuuacgagagcuucgauguggaauccggcgucuauucugugagcuccuuugaggccaagccuagcgggucuguuguggaacaggccgagggagucgagugcgacuucagcccccuucuguccggcaccccuccccagguguacaauuuuaaacgccucguuuucacgaacuguaauuacaaccugacaaaacuucugucucucuucuccgugaaugauuuuaccugcagccaaauuucccccgcugcgaucgccucuaacuguuauagcucccugauucuggacuacuucucuuauccucucagcaugaaguccgaucugagcgucucuuccgcuggcccgaucagccaguuuaauuacaagcagucuuucuccaacccuaccugccuuauucuggccacagugccccacaaucucaccacaaucacgaagccccugaaauauagcuacaucaacaagugcucuagacuucugagcgacgaucggaccgaagucccucagcucgugaaugccaaccaauauucccccuguguuagcauugugccgucuacagucugggaggacggggacuacuaccgcaaacagcuguccccucuggaaggaggcggguggcucguggcuagcggauccaccguugccaugacagagcagcugcagaugggcuuugggaucaccgugcaauauggcacggauaccaauucugucugccccaaacuugaguucgcgaacgacacaaagauugcuagccagcugggaaauuguguggaauacucccucuauggcgugucugggagaggaguuuuucagaacugcaccgccgucggcgugcggcagcaaagauucguguacgaugccuaucagaaccuggucggguacuauagcgacgauggaaauuacuacugucugcgcgcuugcguguccguuccugugucugucaucuaugacaaggagacaaagacccaugccacgcuuuuuggcagcguggcuugugaacacauuuccagcacaaugucucaguacucccggagcaccagaucuaugcucaaacgccgggauuccacauaugggccccugcagaccccuguuggcugcgugcugggacucgucaacagcucucuguucguggaggacuguaaacuuccccugggccaaucccucugcgcccugccggauaccccuagcacacugacgcccuga

SEQ ID NO: 2150 - RNA, 2244 nt, Artificial Sequence; identical to SEQ ID NO: 2058
  derived and/or modified CDS sequence (opt5) from MERS-CoV__ALA49682__S1

SEQ ID NO: 2151 - RNA, 2244 nt, Artificial Sequence
  derived and/or modified CDS sequence (opt5) from MERS-CoV__ALA49803__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagaucgcuauguguacagcgccggccacgcgaccgggacaaccccucaaaaacucuuuguugcuaauuauucccaggacgugaagcaguucgccaacggauuugucgugagaauuggcgccgcugccaauucuacgggcaccguuaucauuagccccuccacaagcgcuaccauccggaaaauuuacccugccuucaugcuggggucuuccgugggaaacuuuagcgauggcaagauggggcgcuucuuuaaucauacacuuguccugcucccggacggauguggcacccugcugagagcguucuacugcauccucgagccccggucugggaaccacuguccugccggaaauuccuauacgagcuuugcuacauaccauacccccucuacagauugcuccgacggcaacuauaaucgcaacgccagccuuaauuccuucaaggaauacuucaaccuuagaaauuguaccuuuauguauaccuacaacauuacagaggaugaaauccuggagugguucggcaucacgcagaccgcucaaggggugcaccucuuuucuagccgguauguggaccuguacggaggcaauauguuccaguuugccacacuuccugucuacgacaccauuaaauauuacuccaucauuccccacagcauccgcucuauucaguccgauagaaaggcgugggccgcuuucuauguuuacaaacugcagccgcucacauuucugcuggacuucagcguggauggguauauccggcgcgccaucgacugcggauuuaacgaucucucucaacugcauuguagcuacgaguccuucgacguggaaucuggcgucuauagcguguccagcuuugaggcuaagccuucuggguccguuguggaacaggccgagggagucgagugcgauuucagcccccuucugucuggcaccccuccccagguguacaacuuuaaaagacucguuuucacgaauuguaacuacaaucugacaaagcugcugucccucuucagcgugaacgacuuuaccugcucccaaauuucucccgccgcuaucgcgagcaauuguuauuccucucugauucuggauuacuucagcuauccucucuccaugaaaagcgaccugucugucuccagcgccggcccgaucucucaguuuaacuacaagcaguccuucagcaauccuaccugccuuauucuggcuacagugccccacaaccucaccacaaucacgaagccccugaaauauucuuacaucaauaagugcagccggcuucuguccgaugaccgcaccgaagucccucagcucgugaacgccaaucaauauagccccuguguuucuauugugccguccacagucugggaggacggggauuacuacagaaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggcggggaguuuuucagaauugcaccgcugucggcgugagacagcaacgcuucguguacgacgccuaucagaaccuggucggguacuauuccgaugacggaaacuacuacugucugcgggccugcgugucuguuccugugagcgucaucuaugauaaggagacaaagacccaugcuacgcuuuuuggcuccguggccugugaacacauuagcucuacaaugucccaguacagcagaucuacccgcuccaugcucaaacggagagacagcacauaugggccccugcagaccccuguuggcugcgugcugggacucgucaauucuucccuguucguggaggauuguaaacuuccccugggccaaagccucugcgcucugccggacaccccuuccacacugacgcccuga

SEQ ID NO: 2152 - RNA, 2244 nt, Artificial Sequence; identical to SEQ ID NO: 2143
  derived and/or modified CDS sequence (opt5) from MERS-CoV__ALA49836__S1

SEQ ID NO: 2153 - RNA, 2244 nt, Artificial Sequence; identical to SEQ ID NO: 2058
  derived and/or modified CDS sequence (opt5) from MERS-CoV__ALA49957__S1

SEQ ID NO: 2154 - RNA, 2244 nt, Artificial Sequence
  derived and/or modified CDS sequence (opt5) from MERS-CoV__ALA50067__S1
augauccacagcguguuccugcucauguuucugcuuacccccacagaguccuacgucgacguuggcccugauucugucaagagcgccugcauugaaguggacauccagcaaacguucuuugauaaaaccuggccgagacccauugacguguccaaggcugaugggaucauuuauccucagggacggacauacucuaacaucaccaucacauaucagggccuguuccccuaccagggggaccauggagauauguauguguacagcgccggccacgcgaccgggacaaccccucaaaaacucuuuguugcuaauuauucccaggacgugaagcaguucgccaacggauuugucgugcgcauuggcgccgcugccaauucuacgggcaccguuaucauuagccccuccacaagcgcuaccaucagaaaaauuuacccugccuucaugcuggggucuuccgugggaaacuuuagcgauggcaagauggggcgguucuuuaaucauacacuuguccugcucccggacggauguggcacccugcugcgcgcguucuacugcauccucgagcccagaucugggaaccacuguccugccggaaauuccuauacgagcuuugcuacauaccauacccccgccacagauugcucugacggcaacuauaaucggaacgcuucccugaauagcuucaaggaauacuucaaccuucgcaauuguaccuuuauguauaccuacaacauuacagaggaugaaauccuggagugguucggcaucacgcagaccgcccaaggggugcaccucuuuuccucuagauauguggaccuguacggaggcaauauguuccaguuugcgacacuuccugucuacgacaccauuaaauauuacagcaucauuccccacuccauccggagcauucagucugaucgcaaggccugggcugccuucuauguuuacaaacugcagccgcucacauuucugcuggacuucuccguggauggguauaucagacgggcuaucgacugcggauuuaacgaucucagccaacugcauuguucuuacgagagcuucgacguggaauccggcgucuauucugugagcuccuuugaggccaagccuagcgggucuguuguggaacaggccgagggagucgagugcgauuucagcccccuucuguccggcaccccuccccagguguacaacuuuaaacgccucguuuucacgaauuguaacuacaaucugacaaaacuucugucucucuucuccgugaacgacuuuaccugcagccaaauuucccccgcugcgaucgccucuaauuguuauagcucccugauucuggauuacuucucuuauccucucagcaugaaguccgaccugagcgucucuuccagcggcccgaucucucaguuuaacuacaagcaguccuucagcaauccuaccugccuuauucuggcuacagugccccacaaccucaccacaaucacgaagccccugaaauauucuuacaucaauaagugcagcagacuucuguccgaugaccggaccgaagucccucagcucgugaacgccaaucaauauagccccuguguuucuauugugccguccacagucugggaggacggggauuacuaccgcaaacagcugagcccucuggaaggaggcggguggcucguggccuccggaucuaccguugcuaugacagagcagcugcagaugggcuuugggaucaccgugcaauauggcacggacaccaacagcgucugccccaaacuugaguucgccaaugauacaaagauugcgucccagcugggaaacuguguggaauacucucucuauggcgugagcgggagaggaguuuuucagaauugcaccgcugucggcgugcggcagcaaagauucguguacgacgccuaucagaaccuggucggguacuauuccgaugacggaaacuacuacugucugcgcgccugcgugucuguuccugugagcgucaucuaugauaaggagacaaagacccaugcuacgcuuuuuggcuccguggccugugaacacauuagcucuacaaugucccaguacagccggucuaccagauccaugcucaaacgccgggacagcacauaugggccccugcagaccccuguuggcugcgugcugggacucgucaauucuucccuguucguggaggauuguaaacuuccccugggccaaagccucugcgcucugccggacaccccuuccacacugacgcccuga

SEQ ID NO: 2155 - RNA, 2244 nt, Artificial Sequence
  derived and/or modified CDS sequence (opt6) from MERS-CoV__AFS88936__S1
augauacacaguguauuucuccuaauguuuuuauuaaccccaacagaaaguuauguagaugugggaccagauagcguaaaaucagccuguaucgaagucgacauacaacaaacuuucuuugacaaaacauggccccgccccauagauguuucuaaagcagauggaauaaucuauccacaaggacgaacuuauucaaauaucacaauuacuuaucaaggacucuuuccauaucaaggagaccauggcgacauguacguuuacagcgcaggccaugcaacagguacaacgccacaaaaauuguucguagcaaacuauucucaggacgugaaacaauuugcuaauggauucguagucagaauaggugcggcagcaaauaguacagguaccguaauaauaucacccuccacaagugcuaccauaagaaaaauauacccagccuuuaugcuaggauccucaguaggaaauuuuucagauggaaagauggggagauucuuuaaucacacacucguuuuauugccagacgguugcggcaccuuacugcgagcauuuuacuguauauuagaaccucgcuccggaaaccacugucccgcagguaacucauacaccaguuucgcaacauaccauacaccagcaacagauugcucugauggaaacuauaaucguaacgcaucccuuaacucauuuaaagaauacuuuaauuuacgcaauugcaccuuuauguacacuuauaauauuacagaagaugaaauauuagaaugguuuggcaucacacaaacagcucaggguguccaucuauuuucaucucgcuacguagaucuuuauggagguaacauguuccaauuugcaacccuacccguauaugacacuauaaaauauuacucuauaaucccacauucaauaaggucaauucaaucagaucgaaaagcaugggcagccuucuauguauauaaacuucaaccuuuaacauucuuacuagauuucucaguagacggauacauuagacgagcuauugacugcgguuuuaaugaucuaagccaacuacauugcucauacgaaucguucgacgucgaaucuggaguuuacucaguuucaucuuucgaagcuaaaccaucaggaucuguaguagaacaagccgaaggcguugaaugugauuuuucaccccuucuaucugguacaccuccacaagucuauaacuucaaacgcuuagucuucacaaauuguaacuauaauuuaacaaaauuacuaagucuauuuucaguaaaugauuuuacauguagucaaauuuccccugcugcaauagccagcaacugcuacaguucccuaauccuggacuacuucaguuauccucuaucuaugaaaucagaucuuuccguaucaagcgccggucccauaucacaauuuaauuauaaacagagcuuuaguaaccccacauguuuaauacucgcuacaguaccacauaaucuaacgacuauaaccaaaccacuaaaauauagcuauaucaacaaaugcucacgguuauuaucagaugauagaacugaaguuccacaacuuguaaaugcaaaucaauacucacccuguguuucaauagucccaaguaccguaugggaagacggagacuauuacagaaaacaacuaucacccuuagaaggcggcgguuggcugguugcaucuggaucuacuguagcuaugacagaacaauuacaaauggguuucgguauaacaguccaauacggaacugauacaaauucuguaugccccaaacuggaguucgcaaacgacacaaaaaucgcuucccaauuagguaauugcguagaauacucauuauacggcguauccgguagaggcguauuucaaaauuguaccgcagucggaguccggcaacaacgauuuguauaugaugcauaucaaaacuuaguaggauauuauuccgaugaugguaauuacuacuguuuacgagcauguguuucugucccagucaguguaauauacgacaaagaaacgaaaacucaugcuacgcuuuuugguucugucgcuugugaacacauaucgucaacuaugucucaauauucgcgaagcaccagaucaaugcucaagcgacgagacucuacauacggacccuuacaaacaccgguugguuguguacuaggacucgucaauucuucauuauuugucgaagauuguaaacuuccauuaggucaaucacucugugcccuaccugauacaccaaguacguuaacacccuaa

SEQ ID NO: 2156 - RNA, 2244 nt, Artificial Sequence
  derived and/or modified CDS sequence (opt6) from MERS-CoV__AFY13307__S1
augauacacucuguauuuuugcuaauguuucuccuaaccccaacagaaucauacgucgaugucggcccugauucaguuaaguccgcauguauugaaguugacauucaacaaacauuuuucgacaagacauggccuagaccuauagacguauccaaagcagacggaauuauuuauccacaaggaaggacuuauucuaauauaacaauaacguaccaagguuuguucccuuaccaaggcgaccacggggauauguauguauacucagccggacacgcaaccgguacuacaccccaaaaacuauuuguagcaaauuauucacaagacgucaaacaauuugcaaauggauuugucguaagaauaggagcggcagcaaacucuacaggaacagucauaauuucaccaucaacauccgcaacuauucguaaaaucuauccugcauucauguuagguagcucaguaggaaauuucuccgacgguaaaaugggcagguucuucaaucacacauuaguauuauugccugauggauguggcacccuauuacgcgcguucuauuguauacuagaaccccguagcggaaaccauugcccugccggaaacuccuauaccucguuugcaaccuaucacacaccggcgaccgauugcucggaugguaauuacaaucgcaaugcuucuuuaaauagcuuuaaagaauacuucaauuuacguaacugcacauuuauguauacauacaauauaacugaagaugaaauuuuagaaugguuuggaauaacacaaacagcccaagguguacaucuguuuucaucacgauauguugaucuuuacgguggaaauauguuucaauucgcaacucuuccuguauaugacacaauaaaauacuacucaauuauaccacauagcauccguaguauacaaucugauagaaaggcaugggcagccuucuacguuuacaaacuccagccauuaaccuuucuauuagauuucucagucgauggcuauauuagacgagcuauagauugcgguuucaaugaccuaucacaauuacauuguucauacgaaucauuugauguugaauccgguguuuauucagucucuagcuuugaagcuaaacccucuggcagcgucguagaacaagcagaaggaguagaaugcgauuucucaccuuuauuaucaggaacuccaccccaaguauacaauuuuaaacgauuaguauucaccaauugcaauuacaaucuaacgaaauuacuauccuuauucuccguaaaugauuuuacuuguucucaaaucaguccugcugcuauugcaaguaacuguuacucauccuuaauuuuagacuacuuuaguuaccccuuaagcaugaaaucugaucuaucugucuccuccgcaggaccaauuucacaauucaacuacaaacagucauuuucaaauccuacauguuuaauacuagcaaccgucccccauaaucuuaccaccauuacaaaaccccucaaauauucuuacauaaacaaauguucaagauuccuaucugaugauagaaccgaaguaccacaacuuguuaaugcaaaccaauacucaccuugugugucgaucguucccucuacaguuugggaagacggugacuacuaucgaaaacaacuaucaccauuagagggaggagguugguugguagcuucaggaagcacaguagcaaugacagaacaauuacaaaugggcuuuggaauaacaguacaauauggaacagauacuaacucagucuguccaaaauuagaauuugcuaacgauaccaaaauagcaagccaacuagggaacuguguagaauacagcuuguacggaguaucaggccgcgguguauuccagaacugcaccgcuguaggaguacgacaacaaagguucguauaugacgcuuaccaaaaccuaguaggguacuauucugacgauggaaacuauuauugccucagagcauguguuucugucccaguuuccguuauauaugacaaagaaacaaaaacgcaugcuacacuguucgguucuguagcaugcgagcauaucucuucuacuaugagccaauacagucgaucgaccagaucaaugcuuaaacgccgagacucuacauacggcccucuucaaacuccagucggaugcguacuaggacucgucaauaguagccuguuuguugaagacuguaaacucccacuaggccaaucccuaugugcuuuaccugauacuccaucuacuuuaacgcccuaa

SEQ ID NO: 2157 - RNA, 2244 nt, Artificial Sequence
  derived and/or modified CDS sequence (opt6) from MERS-CoV__AGH58717__S1
augauacacucaguauuuuuacuaauguuucugcuaacuccaacagaaucauacgucgacgucgguccugacucagucaaaucagcauguauagaaguggauauucaacaaacguucuuugauaaaacauggccacggccaauagauguauccaaagcugacggcaucauauacccucaaggcagaacauacuccaacaucacaauuacuuaccagggacuauuuccuuaucaaggugaucauggugacauguauguauauucagcuggacaugcuacuguuacuaccccucaaaaacuauucguagcaaauuauucacaagacguaaaacaauuugcaaauggcuuuguaguuagaauaggagccgcugcaaauagcacagguacaguaauaauaagcccuagcacaagugcaacaauaagaaaaauuuaccccgcauuuauguuaggaucaucuguagguaacuuuuccgaugguaaaaugggacgauucuucaaccacacauuagucuuacuacccgauggcuguggaacacuccuaagagcauucuauugcauauuagaaccacguaguggaaacuacugcccugcagguaauucauauacaaguuucgcaacauaccauacuccugcaacagacugcucugaugggaacuacaacaggaacgcauccuuaaauucuuucaaagaauauuuuaaccuaagaaacugcacauucauguauaccuauaauaucacagaagaugaaauauuggaaugguuuggaauaacacaaacagcucaaggaguacaccuauucucaucuagauauguggaucucuauggugguaauauguuucaauucgcaacacucccugucuacgauacuauaaaauacuacucaauaaucccucauucaauuuuaagcauacagucagacagaaaggcaugggcagcuuucuacgucuacaaguuacagccacucacauuuuuacuggacuucucuguagauggauauauaagacgagcuauagauugcggauucaacgacuuaucccaacuacacugcucuuacgaaucauuugaugucgaaucaggaguuuauucuguauccuccuucgaggccaaaccuucuggauccgucguugaacaagcagaagguguugaaugugauuuuagcccacuccucucuggaacuccaccacaagucuauaauuuuaaaagauuaguauuuaccaauuguaauuacaaccuaacaaaacuucuaucuuuauuuagugucaaugauuuuacaugcucacaaauuuccccugcagcaauagcaucgaauugcuacucuucuuuaauacuagacuacuucucauauccauuaaguaugaaaucugaucuaucagugucaucagcaggaccaauaagccaauuuaauuacaaacaaucguuuucaaauccuacuugccuaauacuugcuaccgucccacacaaccucacaaccauaacaaaaccuuuaaaauacucauacauaaauaaaugcucacgauuauuguccgacgauagaaccgaaguuccccaauuaguuaacgcuaaucaauacuccccaugugucucaauagucccuuccacaguaugggaagauggagauuacuaucguaaacaacuaucaccucucgaaggaggaggauggcucguagcaagcggaucaacagucgcuaugaccgaacaacuccaaaugggcuucgguauaaccguccaauacggaaccgacaccaauucaguuuguccuaaacuugaauuugccaaugauacaaaaauagcaucccaauuaggaaacugcgucgaauacucccuuuacgguguaaguggccguggaguauuucaaaacugcacagcuguugguguucgccaacaacguuuuguauacgaugcauaucaaaaccucguaggauauuacucagacgacggaaauuauuauugucuccgagcuugugucucaguuccuguaucuguaauauacgauaaagaaaccaaaacacacgccacucucuuuggcaguguagcuugcgaacacaucucuuccacaaugucucaauauuccagaaguacaagaucaaugcuaaaacgaagagauucaacauacggaccuuuacaaacaccuguaggaugcguacuuggauuaguaaauucaucuuuguucgucgaggauuguaaacuacccuuaggacaauccuuaugcgcccuacccgacacaccuucgacccuaacaccuuaa

SEQ ID NO: 2158 - RNA, 2244 nt, Artificial Sequence
  derived and/or modified CDS sequence (opt6) from MERS-CoV__AGN52936__S1
augauucauucugucuuuuuacuaauguuucuacuaacuccuacagaauccuauguugaugucggaccagauucaauaaaaucagcauguauugaagucgacauucaacagacuuucuuugauaaaacuuggccaagaccuauagacguaucuaaagccgacggcauaauuuauccacaaggcagaacauauaguaauauuaccaucacauaccaaggcuuauucccuuaccaaggugaccauggagauauguauguauacuccgcuggccaugcuacagggacaacuccacaaaaacuauucguagcaaauuacucccaagacgucaaacaguucgcaaauggauuuguuguaagaauaggcgcagcagcuaauucaacaggcaccgucaucauuuccccuuccacauccgcuacaauacgaaagauauauccugcauucaugcucggcucaucuguuggcaauuucucugacggaaaaaugggacgauucuuuaaucauacccuaguacuccuacccgaugggugcggcacacuccuaagagccuuuuacugcauacuagaaccaagaaguggaaaccauugccccgccggaaauucuuacacauccuuugcuacauaccacacaccagcuacagauuguucagacggcaacuacaauagaaaugcaucucuaaauucauuuaaagaauauuuuaaccuacgaaacuguacauuuauguauacuuacaauaucacugaagaugaaauuuuagaaugguucggcauaacucaaacagcacaagguguccaucuauuuucaaguagauacguagaucuuuacgguggcaacauguuccaauucgcuacacuaccuguuuacgacacaauuaaauacuacaguauaauuccacauucuauucgaaguauccaaagugaucgcaaagcgugggcagcauuuuauguuuacaaacuacaaccuuuaacauuuuuacuagacuuuucaguagauggauacauacgaagggccauagauugcggauucaaugauuuaucacaguuacauuguucauaugaaucauucgacgucgaaucuggaguuuacucuguuucuucuuucgaggcuaaaccaaguggcagcguaguugaacaagcagaaggaguagaaugcgauuucucccccuuauugucugguaccccaccucaaguauauaacuucaaacgauuaguuuuuacaaauuguaacuacaacuuaacaaaacuacuaucauuauuuucaguuaaugacuucacgugcucccaaaucucuccugcugccauagcaucaaauugcuauucuucacuaauacuugauuauuuuucauauccucucucaaugaaaucagaccuaucaguuucaucggcaggucccauaucccaauucaauuauaagcaaucuuucucuaauccaacaugccuaauauuagcgacaguuccucacaauuuaacuacuauaaccaaaccuuugaaauauucguacauaaauaaauguucuagacuucucucagacgaucguacugaaguaccccagcuaguaaaugcaaaucaauacucaccauguguaagcauaguucccucgacaguuugggaagacggcgauuacuacagaaaacaauugucaccacuagaagguggaggaugguuaguugcaucuggcaguacugucgcuaugaccgaacaauuacaaaugggauuuggaauuaccguacaauaugguaccgauaccaacaguguaugcccaaaacuugaauuugcaaacgacacaaaaauagccucacaacuuggaaauugcgucgaauauucauuauauggaguaucaggacguggcgucuuucaaaauugcaccgcuguuggagucagacaacaacgauucguuuacgaugcauaccaaaaccuagucgguuauuauucagaugauggaaacuacuauugcuuacgagcauguguaucuguaccagucuccguaauauacgacaaagaaaccaaaacacacgcaacccucuucggcaguguagcaugugaacauauauccucuacaaugagucaauacaguagauccacaagaucaaugcuaaagaggagagacuccacuuauggaccauuacaaacacccgugggaugcguacuagguuuaguuaauuccucccuauucguagaagauugcaaacuaccucucggacaaucacuaugcgcacuaccggauacacccaguaccuuaacaccguag

SEQ ID NO: 2159 - RNA, 2244 nt, Artificial Sequence
  derived and/or modified CDS sequence (opt6) from MERS-CoV__AGN70951__S1
augauacauucuguauuuuuacuaauguuucuccuaacaccuaccgaaaguuacguugacguaggucccgacuccguaaaaucagcuuguauagaaguagacauccaacaaacguucuucgauaaaacuuggccaagacccauugacguauccaaggcagacggaauuauauacccacaaggaaggacauauuccaacaucacaaucaccuaccagggauuauuuccuuaccagggagaccacggugauauguauguauauagcgcuggacaugcuacaggaacaacaccacaaaaauuauucgucgcaaacuacucccaagauguuaagcaauuugcuaauggauuuguuguucgaaucggagcagcagcaaauucuacgggcacagucaucaucucuccaucaacaucugcgacaauuagaaaaauauacccugccuuuaugcuagguucuuccguaggaaauuuuucagacggaaaaaugggccguuucuuuaaucacacucuaguauuguuaccugauggaugcggaacacuuuuacgcgcguucuacugcauacuagaaccacguucgggaaaccacugccccgccggaaauucuuauacuucauuugcuacauaccauacaccagcuacugauugcucagauggcaauuacaaucgaaacgcaagucuaaauucguucaaagaauauuuuaacuuacgaaauugcacuuuuauguacacuuacaauauuacagaggaugaaauccuugaaugguuuggaauaacucaaaccgcgcaaggcguccaucuauuuuccagucguuaugucgaccuauaugguggaaacauguuccaauuugcuacccuaccaguguacgacacuaucaaauacuauucaauuauaccacacucuauacguuccauacaauccgacagaaaagcaugggcagcauuuuauguauauaaacuucaaccacuuacuuuccucuuggauuuuucagucgauggauacauccgcagagccauagauugcgguuuuaaugaucuaucacaauuacauuguucauacgaaucuuuugauguagaaucaggcguguacucagucuccagcuuugaagcuaaaccgucagguuccguaguagaacaagcggaaggagucgaaugugauuuuucgcccuuauuauccgguacaccuccacaagucuauaacuucaaaagacuuguauuuaccaacuguaacuacaauuuaacaaaacuacucucccuuuucagcguaaaugauuuuacguguucacaaauauccccugcagcuauugccucaaacugcuauucaucgcuaauucuagauuacuucucuuauccccuaucaaugaaaucagacuuaucaguuaguagugcaggaccuauaucucaauuuaauuacaaacaaucauuuucaaaccccaccuguuuaauacucgcaaccguuccccacaaccuaacaaccauaacaaaaccucucaaauacucauauauaaauaaaugcaguagacuauuaucggacgacagaacagaaguaccucaauuaguaaaugccaaucaauacucuccauguguaucaauagugccuagcaccgugugggaagauggugauuauuaccgcaagcaauuaucaccauuagaggguggaggauggcucguugcaaguggaucaaccguagccaugacagaacaacuucaaaugggauuugguauuacaguacaauauggaacugacacuaauaguguuuguccaaaauuagaauuugcaaaugacacuaaaaucgcaucacaauugggaaauuguguagaauacagccucuacgguguaucgggcagaggaguauuucaaaauuguacagcagugggaguaaggcaacaaagauuuguuuacgacgcguaccaaaacuuaguaggcuauuauucugacgacggcaacuacuauugucuuagagccuguguuuccguaccuguaucugucauuuacgacaaggaaacaaaaacucaugcaacccuuuuuggaucaguagcaugcgaacauauaucuucuacuaugucucaguacucuagaagcacccgcucaaugcucaaaaggcgagacuccacuuaugguccucuccaaaccccuguagguugcguauuaggauuaguaaacucaucccuauuuguagaagacugcaagcuaccacucggacaaucuuuaugcgccuuaccagauaccccaucaacccuaacuccauaa

SEQ ID NO: 2160 - RNA, 2244 nt, Artificial Sequence
  derived and/or modified CDS sequence (opt6) from MERS-CoV__AGV08408__S1
augauucacagcguauuccuguuaauguuuuuacugacuccaacagaaucauauguugaugucggaccagauuccgugaaaagugcaugcaucgaaguugacauacaacaaacauucuuugacaaaaccuggccuagacccauagacguaaguaaggcagaugguauuauuuacccgcaaggucgaacguauaguaacauaacaauaacguaccaaggucuauuuccuuaccaaggagaucauggugauauguacguauacuccgcaggucaugccacugguacaacaccucaaaaauuauuuguggccaacuacucacaagaugucaagcaauuugcuaauggcuucguaguaagaauuggagcugccgccaacuccacagguaccguuauaauaagucccaguacaagugcaacaauccgcaaaauauauccagcauuuaugcuagguaguucuguagguaauuucucagacgggaaaaugggacguuucuucaaccacacacuugugcuccucccagauggauguggcacauuacugagagcauucuauugcauccuagagcccagaucaggaaaccauuguccggcggguaacuccuacacaucuuucgcaacguaccacacaccagccacugauugcuccgauggaaauuacaaucgaaaugcaucacuaaacucauuuaaagaauacuucaaucucagaaauuguacauucauguauacauacaauauaacugaagaugaaauacuugaaugguuuggcauuacacaaacagcucaaggcguccaccucuuuucaucuagauacguagauuuauauggaggaaacauguuccaauuugcgacuuuaccagucuaugauacaauaaaauauuauagcauuaucccccacucaauuagaucaauucaaucagaucguaaggcuugggcagcauuuuauguauacaaacuacaaccucuaacuuuucuacuagacuuuaguguugacggauacauccgucgugcuauagauuguggauuuaaugaucuaagccaauuacauugcucuuacgaaucauucgauguagaaucgggaguauauucaguaucuucuuucgaagcaaaaccuagugguagcguugucgaacaagcagaagguguugaaugcgacuuuagcccccuuuuauccggaacuccuccucaaguauauaacuuuaaacgacuuguuuucacaaauuguaauuauaaccuuacgaaauuacuaucacucuucuccguuaaugauuuuaccugcucacaaauuucacccgcugcuaucgcuaguaauuguuauaguucauuaauacuagacuacuuuucauacccacuauccaugaaaucugaucuaucaguuucaagcgcuggucccauaagccaauuuaauuauaaacaauccuucucaaacccaacaugccuuauccucgcgacuguuccucacaaucuaacaacgauaacaaaaccgcuaaaauacuccuauauaaacaaauguucaagacuccuaucuggagaucgcacugaggugccacaacuugucaacgcuaaccaauauuccccuuguguaucuauuguaccgucgacugucugggaagacggagacuauuaccgcaaacaauuaucaccgcuagaaggaggaggauggcuaguagcuucagguucaacaguugcaaugacagaacaauugcaaauggguuuuggaaucacaguccaauaugguacagauacaaauucuguuugcccaaaacuugaauuugcuaacgauacaaaaauagcaagucaauuaggcaauugcgucgaauauucucuuuacggagucaguggacgaggugucuuccaaaauuguacagcugucggaguuagacaacagagguuuguauaugacgccuaccaaaaucucguuggauauuacucagaugacggaaacuauuauugucuaagggccuguguaucagucccaguuucuguaauauaugauaaagaaacaaagacacaugcaacuuuguuugguaguguagcaugcgaacacauaucuucuacaaugagccaguauucuagaucaacaagaaguauguuaaaaagaagagacucaaccuauggaccacuccaaacacccgucgggugcguccuaggguuaguuaauucaagucuuuuuguggaagauuguaaauuaccgcucgggcaaucauuaugugccuuaccggauacaccaaguacgcuuaccccauaa

SEQ ID NO: 2161 - RNA, 2244 nt, Artificial Sequence
  derived and/or modified CDS sequence (opt6) from MERS-CoV__AGV08455__S1
augauucacuccguauuucuccugauguuuuuauuaacaccaacugaauccuauguagacguagggccugacuccguaaaaagcgcguguaucgagguagacauacagcaaacauucuuugauaaaacauggcccagaccaauagauguaucaaaagccgauggaauuauauauccucaaggaagaaccuauucaaauauuacuauaacauaccaagguuuauucccauaccaaggagaccauggugauauguauguauacucagcaggccacgcgacagguaccacaccccaaaaauuauuugucgcuaauuauucccaagaugucaaacaguuugcaaaugguuucguugugcgaauaggcgcagcagcaaacucaacaggaaccguaauaauaagcccaucaacaucagccacuauucgaaaaauuuacccugcuuuuauguuagguucaucagucgguaauuucuccuacggaaagaugggacgcuuuuucaaucacacacuuguauuauuaccagauggcuguggaacuuuauuacgugcauucuauugcauccuugaaccaagauccggaaaucauugucccgcaggaaacaguuacacaucuuuugcuacauaccauaccccugcgacugacugcagugauggaaauuauaauagaaaugcuucacucaacucuuucaaagaauauuucaaccucaggaauugcacauuuauguauacauacaauaucacagaagaugaaauauuagaaugguuuggcauaacacaaacagcacaaggaguccauuuauuuucaucacgauaugucgaucuauauggcgguaacauguuccaauucgcaacacuccccgucuacgauaccauaaaauauuauucaaucaucccucauaguauacgaucuauacaaucagacagaaaagcaugggcugcuuucuauguauauaaauuacagccacuaacguuuuuauuagacuucucuguugacgguuauauaagacgagcaauagauugugguuucaacgaucuuucccaguugcacugcagcuaugaaucauuugauguugagucaggcguguauucaguuucgucguuugaagccaaaccaucaggaaguguuguagaacaggcugaaggggucgaaugcgauuucucuccacuacuaucuggaacaccaccgcaaguuuacaacuuuaaaagacucguauuuacuaacuguaacuauaaccuaacaaaacuccucucacuauuuucuguaaaugauuuuacuuguagucaaauaagcccagcagccaucgcaucuaacugcuauuccucauuaauacuagauuauuucuccuauccacucagcaugaaaucugacuuaagcguaucaagcgcugggccaauaagccaauuuaauuacaaacaaaguuucagcaacccaaccugccuaauucuagcuacagucccacauaacuuaacuaccauaacaaaaccgcugaaauacucguacauaaacaaauguucccgauuacuuagcgaugauagaacggaagucccucaacuuguaaacgcuaaucaauauucacccugugugucaauaguacccucuaccguaugggaagauggugauuacuacagaaaacaauuaucgccuuuagaagggggagguuggcuugucgcaucagguaguacaguagccaugaccgaacaauuacaaauggguuucggaaucacaguucaguauggaacagauaccaauuccguaugcccaaaauuagaauuugcaaaugauacaaaaauugcaucucaauuggguaauugcguugaauacucacuuuaugguguaucgggacgcggcguauuucaaaauuguaccgcaguaggcguuagacaacaacguuucgucuaugacgccuaucaaaaucucguaggguacuacagugaugauggaaauuauuauugccucagagcaugugucucaguaccaguaucaguaaucuacgauaaagaaacuaaaacccaugccacacuauuugguucuguagcuugugaacacauauccucaacuaugagucaauacucccguaguaccagauccaugcuuaaacgaagagauucgacauauggcccauuacagacuccaguaggauguguauuaggacucguuaacucuucauuauucguugaagauugcaaacuaccacuaggacaaucuuuaugugcauugcccgauacuccaucaacuuuaacgccauga

SEQ ID NO: 2162 - RNA, 2244 nt, Artificial Sequence
  derived and/or modified CDS sequence (opt6) from MERS-CoV__AGV08467__S1
augauccacucuguauucuuauuaauguuccuacuaacaccaaccgaaucuuaugucgacguaggucccgauucagucaaaucugccugcauagaagucgauauacaacaaaccuucuucgauaagaccuggcccaggccaauagacguauccaaagcagaugguauaauauacccucagggaagaaccuauucaaacaucacaauuacauaccaaggacucuuuccauaccaaggagaucauggagauauguauguauauucggcaggacacgcaacugguacuacaccacaaaaacuuuuuguugcuaacuacucccaagacguaaaacaauuugcaaauggauuuguuguccgcauaggagcugcugcaaauucaacuggaacaguaauuauuucaccaucuaccucugcuacgauacgcaaaauuuaccccgcauuuauguugggaucaucugucgguaacuuuucagauggaaaaaugggaagauucuucaaccauacauugguacuacucccugauggcuguggaacucuacuucgagcauuuuacuguauacuggaacccagauccgguaaccauuguccagcagguaacucauacacaaguuucgccacauaucacacuccugccaccgacugcuccgacgguaauuacaaucgaaaugccucacuaaacuccuucaaagaauacuuuaaccugcgcaacugcacuuuuauguauacuuacaacauuaccgaagacgaaauucuagaaugguuugguauaacucaaacagcacaaggaguacauuuauucucaagccgauacguugaccuauauggaggcaauauguuccaauucgcaacacugccaguauaugauacaaucaaauauuacuccaucauuccccauucuauuagaucaauacaaucugacagaaaagcaugggcagcuuucuacguuuacaaguuacaaccucucacauucuuacuagacuuuucaguagauggauauauucgccgagccauagacugcggauucaacgaccuaucacaauuacacuguuccuacgaaucauuugauguagaaucaggaguuuauucaguguccaguuucgaagcuaaaccaagcggaucagucguagaacaagcugaggguguagaaugugauuucucaccauuacuaucugguacaccuccccaagucuauaauuucaaacgccuagucuucacuaauuguaauuauaaucucacuaaacuacuuaguuuauucucugugaaugauuuuacaugcucucagaucucacccgcagcaauagccucgaauugcuacagcucacuaauacuugauuacuuuaguuacccauuaucaaugaaaucagacuuaucuguuucaagcgcaggucccauaagucaauuuaacuauaaacaaucauuuucuaauccaaccugucuaauacucgcaacuguuccucauaaucucacaacuauaacaaaaccgcucaaauauucauacauaaacaaaugcucucgauuauuaucagaugaccguacagaaguaccacaauuaguaaaugcaaaccaauacucaccguguguaagcauuguuccaucaaccguuugggaggacggagacuacuaucguaaacaacuaucaccccuugaggguggcggaugguuaguugcgucuggauccaccguggccaugaccgaacaacuucaaaugggauuugguaucacuguacaauauggaacagacaccaauucugucuguccuaaacuugaauuugcaaaugacacaaaaauagcaucucaauuagguaauugcguagaauacucacuguauggcguaagugguagaggcguauuucaaaauugcaccgcuguaggagucaggcaacaaagauuugucuaugacgcuuaccaaaacuuaguagguuauuacucggaugauggaaacuauuauugccuacgugccugugucucaguacccguauccgucauuuacgacaaagaaacuaaaacacaugcaacucuauuugggucuguugcuugugaacauauaucuuccacuaugucacaauacuccagaagcacgagaucuaugcucaaaagacgugacucaaccuacgggccacuucagacacccguuggauguguacucggauuggucaacucaucauuauuuguagaagauugcaaauuaccacuuggccaaagucucugugcacuacccgacacaccaaguaccuuaacgcccuga

SEQ ID NO: 2163 - RNA, 2244 nt, Artificial Sequence
  derived and/or modified CDS sequence (opt6) from MERS-CoV__AGV08492__S1
augauacacagcguuuucuuauuaauguuucucuuaaccccuacagaauccuauguagauguuggaccagauuccgucaaauccgcgugcauagaagucgacauccaacaaacauucuuugauaaaacauggccucgaccuauugauguaucaaaagcugauggaauuauuuacccucagggcagaacauauucaaauauuacaauuacauaccaaggccuuuuuccuuaucaaggagaccacggagauauguacguauauuccgcuggccaugcuacgggcacaacuccucagaaacuauucgucgcaaacuacucacaggaugucaaacaauuugcuaacgguuuuguaguccgaauaggagcugcagcuaacucgacaggaaccguaaucauuagcccuagcacauccgcuacaauacgaaaaaucuaccccgcauuuaugcucggaagcucgguuggcaauuucucugauggcaaaaugggucgauuuuucaaucauacucuagucuuauuaccagauggcugcggaacauuauuacgugcauuuuauugcauacuagaacccagaucaggaaaccauuguccagcugguaauucauacaccaguuuugccacuuaucacacuccugcuacagacuguucugauggaaacuauaacagaaaugccucacucaauagcuucaaagaauauuuuaaccucagaaauuguaccuucauguacaccuacaauaucacagaagaugaaauacucgaaugguuuggcauaacgcaaaccgcacaaggcguccauuuauuuaguucacgcuacgucgaucuauauggcggcaacauguuucaauucgcuacccuacccguuuacgauaccauaaaauauuauuccauuauaccucacaguauucgaucaauacaauccgaucgaaaggcuugggccgcuuuuuacguauauaaacuccaaccacucacuuuccuacuugauuucucuguagacgguuauauaagacgcgccauagauugcggauucaacgacuuaucacaacuacauuguucauacgaaucauuugacguagaaucaggugucuauucuguuucaucauuugaagcaaaaccaucuggauccguaguugagcaagcagaaggcgucgaaugugacuuuucaccuuuacuaucaggaacaccuccacaaguauauaauuuuaagcgauuggucuucacaaauuguaacuacaacuuaacaaaauuacuuucacuauuuagcgucaaugauuucacaugcucucaaaucucaccagcagcaauagccagcaacuguuacucuucacuaauuuuagacuauuuuucauauccccuuucgaugaaaucagaccuaucaguuagcagugcaggaccaaucucacaguuuaauuauaaacaaucauuuucaaauccaacaugccuaauucuggcaacuguuccccacaacuuaaccacaaucacaaaaccacucaaguacagcuacauuaacaaauguucaagauuacucucugaugauaggacagaaguuccccagcuaguaaaugcaaaccaauacuccccaugcgucucuauaguacccucuacagugugggaagauggcgacuacuacagaaaacaacuuuccccauuagaaggaggcggauggcuuguagcaucuggauccacuguagcaaugacugaacaacuucaaauggguuuuggaauaacuguacaauacggaacggauacaaauucaguuugcccaaaauuagaguucgcaaaugauacaaaaauagcaucacaacuagguaacugcguagaauacucuuuguaugguguaucugggagaggugucuuucaaaauugcacugcuguuggaguuaggcaacaaagauuuguauacgacgcuuaccaaaauuuaguuggcuacuauagugaugacggaaauuauuacugccuccgugcauguguaucuguacccguuuccguuaucuacgauaaagaaacuaaaacacaugcgacacucuuugggucagucgccugugaacauauaucuucuacuaugucccaauacagcagauccacacggucgaugcucaagagacgagauuccaccuaugggccacuccaaacaccaguagguuguguguuaggucucguaaacucaucucuauuuguagaagacugcaaacuaccacuaggacaaagucuaugcgcuuuaccagauacaccaucuacacucacacccuag

SEQ ID NO: 2164 - RNA, 2244 nt, Artificial Sequence
  derived and/or modified CDS sequence (opt6) from MERS-CoV__AGV08584__S1
augauucauucuguuuuucuacuaauguucuuauuaacaccaacugaaagcuauguagauguugguccagauucuguuaaaucagccuguauugaaguugacauucaacaaacauucuuugacaaaaccuggcccagacccaucgaugugucaaaggcugacgguauaaucuacccucaaggaagaacauauucuaacauuacaauaaccuaucaaggauuauucccuuaccaaggagaccauggagauauguacguuuacagugcuggucacgcuacaggcaccacaccccaaaaacuauucguagcgaacuauucacaagacguuaaacaauucgcaaacgguuuuguggucagaaucggagcggcagcuaauuccacggguacaguaauuauaagcccaucaacuucugcuacaauaagaaagauuuacccugcauuuauguugggaagcuccguaggaaacuuuucagacgguaagaugggccgauucuuuaaccacacauuaguauuacuuccugacggcuguggaacauuauuacgcgcauucuacuguauucuugaacccagaucaggaaaccacugcccugcuggaaauagcuauacaucauucgcaacauaccauacaccagcgacagacuguagcgauggaaacuacaauagaaaugcaucccuaaauagcuuuaaagaauauuuuaacuuacgaaacuguacguucauguauacauacaauauaacugaagacgaaauacucgaaugguucggaauaacacaaaccgcacaaggaguccaucuauuuagcucaagauacguagaucuauacgguggcaauauguuccaauuugcaacauuaccaguauaugauacaauaaaauauuacucaauuauuccacacucuauccguucaauacagagcgaccgaaaagcaugggcagcauucuacguauauaaacuacagcccuuaacauuucuuuuagacuuuuccgucgacgguuauauuagacgagcuauagauugcggcuucaaugauuuaagccaacuucauuguucauacgagagcuucgacguagaaucuggugucuauucaguaucauccuucgaagcuaaaccuucaggguccguuguagaacaagcagaagguguagaaugcgauuucucaccacucuuaucaggcaccccaccacaaguauauaacuuuaaaagauuaguauuuacaaacuguaauuacaauuuaacaaaacucuuaucuuuguucagcguaaacgauuucacuuguucccaaauauccccagcugcaauugcaucuaacuguuacaguagcuuaauuuuagacuacuuuaguuauccccuuucgaugaagucagacuugucgguaucaucagcugguccaaucucacaauuuaacuacaaacagucuuuuucuaacccaacaugucucauacuugcuacaguuccccauaaccucaccaccauaacuaaaccauuaaaauauucuuacaucaacaaaugcucacgauuacuaucugacgaccgaacugaaguaccacaauuaguuaaugcuaaucaauacaguccaugcgucagcauaguaccaaguaccgcuugggaagacggcgauuauuauagaaagcaacuuucaccuuuagaaggaggugguuggcuaguagcuaguggauccacaguugcaaugacagaacaacuucaaaugggcuuugggauaaccguacaauauggaacagacacaaacagugucuguccaaaacuagaguucgcaaacgacaccaaaauagcuucacaauuaggcaacuguguagaauauucacucuaugguguaucuggcagagguguuuuucaaaauugcacugcaguuggcguccgacaacaaagauuuguauaugaugccuaucaaaauuuaguugguuacuauucagaugauggcaacuauuacugccuacgugcaugugucuccguaccaguuucaguaauuuaugacaaagaaacuaaaacacaugccaccuuauuuggcucaguugcuugugaacacauuucuucaacuaugagucaauacagucgaucaacaagaagcauguuaaaacgcagagacaguacguaugguccgcuucaaacacccguaggaugcguccuuggccuaguuaacagcuccuuauuuguagaagauugcaaacucccguuagggcaaucacuuugcgccuuaccagauacaccuucaacuuuaaccccuuaa

SEQ ID NO: 2165 - RNA, 2244 nt, Artificial Sequence
  derived and/or modified CDS sequence (opt6) from MERS-CoV__AHB33326__S1
augauucacuccguuuuccucuuaauguuuuuauuaaccccaaccgaaagcuacguagauguuggaccagauucuguaaaaucggccugcauagaagucgauauucaacaaacauucuucgacaaaacauggccuagaccaauagauguuucaaaagcagacggaauaauauauccucaagguagaacuuacaguaauaucacuauaacauaccaagggcuuuucccguaccaaggggaccauggugauauguacguuuauucagcaggccaugccacuggaacaacaccacaaaaacuuuucguagcgaauuauucacaagauguaaaacaguuugcuaaugguuuugucgucagaauaggagcagcggcauauaguacugguacggucaucauaucacccucaacaagcgcaacaauucguaaaauauaucccgcuuuuauguuaggaucuucaguaggcaauuuuagcgauggaaaaaugggccguuucuucaaucauacucuaguucuacuaccugauggcuguggaacacuacugagagcguucuacuguaucuuggaaccacguaguggaaaccauugcccagcagguaauucuuauacaucauuugcaaccuaucacacuccugcaacugauuguucagacggaaauuacaacagaaacgcuagccuaaauuccuucaaagaauauuuuaaucuacgcaacugcacauucauguauacuuauaauauuaccgaagaugaaauccucgaaugguucggcauaacgcaaacugcacaagguguacauuuauuuuccagcagauauguagaucucuaugguggaaauauguuccaauucgcuacuuugccugucuacgauaccauuaaauauuauagcauaaucccccauucaauacguucuauccaaagcgaucgaaaggcuugggccgcauucuauguauacaaauuacaaccacuuacauuucuguuagacuuuucuguugacggcuacauaagacgagcaauagauugcgguuucaaugaucuuucucaacuccauugcucauaugagucuuucgauguagaauccggagucuauucagucucaaguuuugaagccaaaccaucuggcagugugguagaacaagcugagggagucgaaugcgacuuuucaccauuauuaucaggcacucccccacaagucuacaauuucaaaagauuaguuuucacaaauuguaauuauaaucuaacuaaacuccuaucuuuauucagcguaaacgauuucacauguucucaaauauccccugcugcaauugcaucuaacuguuacucuucacucauauuagauuacuuuaguuauccacuaagcaugaaauccgacuuaagcguaaguucugcaggaccaauaucacaauuuaauuauaagcaaucuuuuucaaacccaaccugcuuaauucuugccacaguuccccauaaccuuacuacaauaaccaaaccguuaaaauacucauacauuaauaaauguucacgauuacuaucagaugaccguacagaaguaccucaauuaguuaacgcgaaucaguauaguccaugugucuccauaguaccuucaacagucugggaagauggagacuacuauagaaaacaacucagcccacuggaaggaggcgguuggcuugucgcuucugguucaacaguugcaaugacggaacaauuacaaaugggauuuggaauaacuguccaauacgguacagacacaaacuccguaugcccaaaguuggaauuugcuaacgacacgaaaauagcaucccaauuagguaauugugucgaauauucucuauauggagucucuggaaggggcguauuccaaaauuguacugcuguaggugucagacaacaacguuuuguuuaugacgcauaccaaaaccuagugggauauuauuccgaugauggaaauuauuacuguuuacgugcuuguguuucaguacccgucagcguaaucuacgauaaagaaacaaagacccaugcuacauuguuuggaucagucgcaugugaacacauuucauccaccaugucacaauacucucguuccacaagaucuauguuaaaaagaagagauucaacauauggaccacuucaaacacccgucggcugcgucuuaggacuuguaaauucaaguuuauucgucgaagauuguaaguuaccauuaggucaaagccuaugcgcucuacccgauacuccaucaacuuuaacuccauag

SEQ ID NO: 2166 - RNA, 2244 nt, Artificial Sequence
  derived and/or modified CDS sequence (opt6) from MERS-CoV__AHC74088__S1
augauacauucagucuucuuacuaauguuccuacuaacaccaaccgaaucuuauguagauguuggccccgauuccguaaaaucagcuuguauagaaguugacauucaacaaacauuuuucgauaaaacguggcccagacccauagaugugucaaaagcugacggaauaaucuacccccaagggcggacguauucgaauauaacuauaacauaucaaggacuguucccauaucaaggagaccacggggauauguauguauacucugcaggucacgcaaccggaacaacaccacagaagcuauuuguugcaaauuacucacaagauguuaaacaauucgcaaauggcuuuguaguucgcauuggugcagcugcaaacucuacgggaacaguuauaauaucuccgucaacuagcgcaacaauacgaaagaucuauccagccuucauguuaggcucaucugucggcaauuuuuccgauggcaaaaugggacgcuucuuuaaucauacacucguuuuauuaccagacggauguggaacacuucuacgggcauuuuacuguauccuugaaccacggucuggcaaccacuguccagccggaaauuccuauaccucauucgcuacuuaucacacaccagcuacagauugcucagauggcaauuacaauagaaacgcaucccucaauucuuuuaaagaauacuuuaacuuacgaaacugcacauucauguauacuuacaauauuacagaggacgaaauacuagaaugguucggaauuacccaaaccgcacaagguguucaccuauuuucaucacgauauguugaucuuuacggaggaaacauguuccaauucgccacacuuccaguguaugacacaauaaaauauuauuccaucauaccacacuccauuagaucaauacaaucagacaggaaggcuugggcagcauuuuauguauauaaauuacaaccucucacauuuuugcuugauuucuccgucgacggauacauucguagagcaauugauugcggauucaacgauuuaagucaacuacauugcucuuacgaauccuuugauguagaaagcggcgucuauucaguaucgucguuugaagcaaaaccaucugguaguguaguugaacaagcagaagguguagaaugugauuuuagcccuuuacuaucaggaacaccaccccaaguauacaauuuuaaacguuuaguauuuacaaauuguaauuauaaccuaacaaaacuucuuucacucuucuccguaaaugauuuuacuugcucacaaauauccccagccgccaucgccucaaacugcuacucaucacuuauacuugauuauuucaguuauccacuaucaaugaaaucugaucucaguguuaguuucgcaggacccaucucccaauucaacuacaaacaaucuuucucaaacccuacaugccuaauucuagcuacaguaccccauaacuuaacuacaaucacaaaaccacuuaaguacagcuacaucaacaaaugcucacgauuacuaagugacgaccggacagaagugccucagcuaguaaacgcuaaccaauauaguccuuguguaucaauagucccaucuacagucugggaagacggagauuauuaucgaaaacaacuaucaccacuugaggguggugggugguuagucgccagcggaucaacuguagcuaugacugaacaacuacaaaugggauuugguauaacaguacaauauggaacagacacaaauucaguuuguccaaaauuggaauuugcuaaugacacaaaaauagcaucccaauuagguaauugcguugaauauucacuauauggcguaucggguagaggcguuuuccaaaauuguacagccguaggcguacgacaacaaagauucguuuaugacgcauaccaaaaucuugugggauauuauucagacgacggcaacuauuauugucuaagagcaugcguaucuguaccuguuuccguaauauacgacaaagaaaccaagacacaugcuacucuguuuggaagcgucgcaugugaacacaucaguucuacuaugagccaauacuccagaucaacaaggucaaugcuaaaaagacgugauucuacuuacggaccucuacaaaccccgguaggaugcgucuuagguuuagugaacuccucccuuuucguagaagauugcaaauuaccuuuaggacaaucauuaugugcacucccagacacuccaaguacccuuacaccuuaa

SEQ ID NO: 2167 - RNA, 2244 nt, Artificial Sequence
  derived and/or modified CDS sequence (opt6) from MERS-CoV__AHI48528__S1
augauacacucaguguucuuacucauguuccuacucaccccuacagaaucauacguagauguuggaccugacucaguuaaaucugcuuguauagaaguagacauacaacaaacuuucuucgacaaaacuuggccaagaccaaucgauguaucuaaagcagaugggauuauuuauccccaagguagaacauacucuaauauaacgauaacuuaccaaggccuauucccauaucaaggagaucauggcgauauguauguauacuccgcuggccaugcuaccgggacaacaccacaaaaacuauuuguagccaacuauucccaagacguuaaacaauucgccaacggauuugucguccguauuggugcugcagcaaacucaacagguaccgucaucauuucaccaagcacaucagcuacuauacgaaaaaucuauccggcuuuuaugcugggcucaucugucggaaauuucucagaugguaaaaugggaagauuuuucaaccacacauuaguauuacucccugacggauguggaacccuacuaagagcuuuuuauuguauacucgaaccucgaucugguaaucacugucccgcugguaauucuuauacaucuuucgcaacauaucauacaccagcgaccgauugcuccgacgguaauuauaauaggaaugcaucuuuaaauucauuuaaagaguauuuuaaucugcggaauuguaccuuuauguacacauauaacauuacagaagaugagauauuagaaugguuuggaauaacucaaacagcucagggaguacacuuauucagcucgcguuacguagaucuguaugguggaaauauguuccaauucgccacacucccaguauaugauacgauuaaauacuauucuaucauaccacacucuaucagaucaauacaaucagaucgaaaagccugggcugccuuuuauguauacaaacuacaaccucuuaccuuccuacuagauuucagcguugauggauauauaagacgagcaauagacugcgguuucaaugaccucucacaacuucauuguucguaugaaucauuugauguugaaagcggaguguauucuguaagcucuuuugaagcaaaaccuagcgggucgguugucgaacaagccgaaggcgucgaaugugacuucuccccauuacucucaggcaccccuccgcaaguauauaacuucaaacgacucguuuucacaaauugcaauuauaaccuuaccaaacuacuuucacucuuuuccguuaacgauuucacuuguagucaaaucuccccacccgcaauagcaaguaauuguuauucuagucuaauauuggauuauuuuucuuauccucuuucuaugaaaucagaccuaucagucuccucugcuggccccauaucacaguucaacuauaaacaaaguuuuucuaaccccacaugcuuaauucuuguaacugucccacauaaucucacuacaaucacuaaaccauugaaauauucuuacauaaacaaaugcucacgacuauugucagaugacagaacggaaguaccacaacuuguuaacgcaaaccaauauucaccaugcguuuccauaguaccaucaacuguaugggaagauggagacuauuauagaaaacaguuaucaccucuagaagguggcgguuggcuagucgcaucagguucuacaguagcaaugacugagcaacuacaaaugggauucgggauaaccguacaauauggaacagacacgaacuccguaugucccaagcuggaauuugcaaacgacacaaaaauugccagucaacucggaaacugcguagaauacucucuauaugguguauccgguagagggguauuccaaaauugcacagcaguaggaguaagacaacaaagauucguauacgacgcauaucaaaauuuaguagguuauuacucagaugacggaaauuauuauugccuacgagcaugcgucucgguucccguaagcgugaucuacgauaaagaaacaaaaacacaugcuacccuauuuggaucaguugccugugaacauauaagcucaacuaugagucaauauuccaggagcacccgaucaauguuaaaacgucgagauucuacauauggaccucugcaaaccccagucggaugcguauuagguuuaguaaauucaucccucuuuguggaagacuguaaacuccccuuaggccaaucucuaugugcauuacccgauacacccagcacauuaacaccguaa

SEQ ID NO: 2168 - RNA, 2244 nt, Artificial Sequence
  derived and/or modified CDS sequence (opt6) from MERS-CoV__AHI48550__S1
augauucauucaguauuucuccuaauguucuuacuaacuccuacagaaaguuacguagacgucggcccugauucugucaaaucggccuguauagaaguugauauacaacaaacuuucuuugauaaaaccuggccccgacccauagacguuucaaaagcagaugguauaauauauccccaaggacguaccuauucuaauauuacuauaacauaucaaggcuuauuuccauaucaaggagaucauggagauauguauguauacuccgcuggacacgcaacaggaaccacaccucaaaaacucuucguagcaaauuauucucaagauguaaaacaauucgcaaaugguuuugucguaagaauuggugcagcugcaaacucaacuggaacagucauaauuucuccuuccacaucugcaaccauaagaaaaauuuaccccgcuuuuaugcuaggguccuccgugggaaacuuuucagacgguaaaaugggacgguucuucaaucacacauuaguauuacucccugacggaugcggaacacuucuccgagcuuuuuacuguauacuagaaccaagaucuggaaaccacuguccugcaggaaauuccuacacuucuuucgccaccuaucauaccccagccacagauuguuccgauggaaauuacaauagaaacgccuccuuaaacucauucaaagaauauuuuaaucuaagaaauugcacauuuauguauacauauaauauaacagaagaugaaauucuugaaugguuuggaauaacacaaacagcacaaggcguacauuuauuuucaucuagauacguagaccuguacggugguaauauguuccaauucgcgacacuuccaguauacgacaccauaaaauauuauucuaucauaccccauagcauacgaucuauacaaucagauagaaaagccugggccgcuuucuauguuuauaaauuacaaccacucacguuccuacuggauuuuuccguugauggauauauaagacgagcuauugacugcggguuuaaugacuuaucccaacuacacugcucguacgaaaguuucgacgucgaaagcgguguauauuccgucucaucauucgaagcuaaacccucagguucuguaguagaacaagcugagggcguagaaugugauuucucaccacugcucucagguacaccuccucaaguauacaacuucaaacgauuaguauuuacuaacugcaauuauaacuuaacaaaauuacucucccuauuuagcgucaaugacuucaccuguucucaaauauccccugcugccauugcaucuaauuguuauuccucccuuauauuggacuauuuuagcuacccccuuucaaugaaaagugaucuaucagucucuucagcaggaccgauaucucaauuuaacuauaaacaaaguuucucaaauccgacuuguuuaauccuagcgaccguaccccauaauuuaacgacaaucacaaaaccucuaaaauauucauacauaaauaaguguucuagauuauuaucugaugacagaaccgaaguaccacagcuuguuaacgccaaccaauacucaccaugcguaucaauaguaccuucuacagucugggaagauggagacuauuaccgaaagcaauuauccccauuggagggcggaggaugguuaguugccucaggaucaacaguggccaugacagaacaacuacaaaugggauucggaauuacuguucaguauggaacagauaccaauuccguauguccaaaacucgaguucgcuaacgacaccaaaauugccucacaacuagggaacuguguagaauacagcuuauacggaguaucaggaagaggugucuuucagaacugcacagcaguuggaguaagacagcaaagauucguuuacgaugcuuaucaaaaccuagucggauacuauagugacgacgggaauuacuacugccuacgagcauguguuucuguaccaguaagugucaucuacgauaaagaaaccaaaacccaugccacguuauucggaucaguagcuugcgaacacauauccucaacaaugucccaauacucgcguucaacucgaucgauguuaaaacgacgagacaguacauaugguccacuccaaacaccagucggcuguguacuuggacuuguaaacuccucacuuuuuguagaagauuguaaacuuccacuaggccaaucgcucugcgcacuuccugacacucccucaacauuaacucccuga

SEQ ID NO: 2169 - RNA, 2244 nt, Artificial Sequence
  derived and/or modified CDS sequence (opt6) from MERS-CoV__AHI48583__S1
augauacacuccguauuucuccuaauguuccuucucacaccuacagaaucauauguugacguagguccugacucaguuaaaucugcauguauagaaguugauauccaacaaacauucuuugauaaaaccuggccuaggccgaucgauguauucaaagcagauggcauaaucuacccacaggguagaacauauagcaacauaacuaucaccuaucaaggacucuucccuuaucaaggagaccauggcgauauguaugucuauucagcaggccacgccacagguacuacaccacaaaaauuauuugucgcaaauuacucccaagacguaaagcaguucgcuaauggauucgucguaagaauaggugcugccgcaaauuccacuggaacaguaauaauuucgccaaguaccagugcuacaauucgaaaaauuuaucccgcauuuaugcuagggucuucaguagguaauuucagcgaugggaagaugggacgcuuuuucaaccacacacuuguccuucuaccagacggaugugguacacuccuccgcgcuuucuacuguauuuuagaaccuagaagcgguaaucauugcccagcagggaacucauacaccucuuucgccacauaccauacacccgcaaccgacuguucugacggcaacuacaauagaaacgccucacucaacaguuucaaagaauauuuuaauuugagaaauuguacauucauguacacuuauaauauaacugaagaugagauauuagaaugguuuggaaucacacaaacagcccaaggaguccacuuguuuucaucccgcuauguugaccuauacgguggaaacauguuucaauucgcaacccuaccgguauacgacacaaucaaauacuauaguauuauaccacauucaauaagaaguauucaaucagacagaaaggcuugggcagccuuuuauguuuacaaacuacaaccuuugacauuuuuauuggauuuuuccguagaugguuauauaagacgugcaauagacugcgguuucaaugacuuaagccaacuacauuguucauacgaaucauuugauguagaaagugguguauacucgguaucaucauuugaagcaaaaccaucagguucuguaguagaacaagccgaaggagucgaaugcgauuucucaccccuauuauccggaacacccccucaaguuuauaauuuuaaacgucuagucuuuaccaacuguaauuauaacuugacgaaacuacugucuuuauuuucuguuaaugauuucacauguucacaaauuucgccagcggcaauugcuucaaauuguuacuccucauugauacuagauuacuuuucauauccauuaucaaugaaaagcgauuuaagugucucuucugccgggccaauaucucaauuuaacuacaaacaaucuuuuagcaaucccaccugucugauucuagcaacuguaccacauaacuuaacaacaauaacaaaaccccucaaauauucauacauaaauaaaugcucaagacuauuauccgacgaucguacagaaguaccacagcuaguaaaugcgaaucaauacucuccauguguuucuauaguuccaucuacuguaugggaagacggugauuauuacagaaaacaauuaaguccacuugaaggcggugguugguuaguggcaucugguucuacaguagcaaugacagaacaacuacaaaugggauucggcauaacaguacaauacggaaccgacacuaacuccgucuguccaaaauuggaauuugcaaaugauacuaaaauugcaucucaacucggcaacugugucgaguauaguuuauacggugucaguggaagaggaguauuccaaaacugcacagcaguaggcgugcgucaacaaagauuuguauacgaugcuuaccaaaaccuggucggcuauuauucagaugacggaaauuacuacuguuuacgugcauguguaaguguaccaguuucagucauauacgauaaagaaacaaaaacacaugccacgcuuuuugguagcgucgcuugcgaacacauaucaucaacgaugagucaauacagcagaucuacucguaguaugcuaaaaagacgagauaguacauacggaccccuacaaacgcccguaggauguguacucggauuaguaaacuccucacuuuuuguagaagauuguaaacuaccccuaggccaaucucuaugugcacuaccugauacaccuuccaccuuaacaccuuaa

SEQ ID NO: 2170 - RNA, 2244 nt, Artificial Sequence
  derived and/or modified CDS sequence (opt6) from MERS-CoV__AHI48605__S1
augauucauucugucuuucuucuaauguuucuacuaaccccuacugaaucuuauguugauguagguccagauaguguuaaaucugcauguauugaaguagacauacaacaaacauucuuugacaaaacauggccaagaccuaucgauguaagcaaagcagacggcauuauauacccccaaggccguaccuauucaaacaucacuauuacuuaucagggauuauuuccuuaccaaggagaccauggagacauguacgucuacucagcuggacacgccacaggaacaaccccgcaaaaauuauuuguugcaaauuacucccaagauguaaaacaguuugcuaacgguuuuguaguaagaauuggugcagcagccaauucuacaggcacaguaaucaucucaccuuccacauccgcaacuauuagaaaaaucuacccagcuuucaugcuaggaucaagcguagguaacuucucagauggaaaaaugggccgauucuuuaaccacacacuuguucuacuaccagacggcugcggaacucugcuccgugccuucuauugcauucuggaaccacguaguggaaaccauugcccagccgggaacuccuauacaucuuuugcaacauaucauacaccggccacagauuguuccgacgguaauuacaaucgcaaugcgucucuuaauuccuuuaaggaauauuuuaaucuacguaacugcaccuucauguauacauacaauaucacugaagaugaaauuuuagaaugguucggaauaacucaaacagcucaaggaguacacuuauucucuucaagguacguagaucuauaugguggcaacauguuccaauuugcgacccuuccuguuuaugauaccauaaaguauuauucuauuauuccacacucaaucagaucaauacaaucagaucggaaggcuugggccgcauucuacguuuacaaauugcaacccuuaaccuucuuacuugauuucucaguagaugguuacauuaggagagcuaucgacugugguuuuaaugaucuaagccagcuacauugcucauacgaaucauuugauguagaaagcggcguauacucagucaguuccuuugaagcuaaaccuaguggcuccguuguugaacaagcugaaggaguggaaugugacuuuucaccucuccucucagguacaccaccacaaguauacaauuuuaaaagauugguauucacaaauugcaauuauaaucuuacaaaauuacuaucauuauuuucaguaaaugauuuuacaugcucacaaauaucuccugcugcuauagcaucaaauuguuauuccucauuaauucuagauuauuuuucauauccccuuaguaugaaaucagaccuuuccgucagcucugcaggaccaauaucacaauucaacuauaaacaauccuucucuaauccuaccugucuaauauuagcuacaguaccucauaaccuaacaacaauaacuaaaccguuaaaauauucauauauaaauaaauguucgcgccuccuaucagaugaucguaccgaagucccucaacuuguaaacgcaaaccaauauagcccaugcguaucuauaguacccucuacaguaugggaagauggugauuacuaccgaaaacaauuaucaccucuagagggagguggaugguuaguugccucaggaucaaccguagcaaugacugaacaauuacaaaugggcuucggaauaaccguccaauauggaaccgauacaaauucaguauguccuaaacuagaauuugcaaacgauacaaaaaucgcaucccaguuaggaaauugcgucgaguacuccuuauacggaguaagcggaagaggaguauuccaaaacuguacagcuguuggaguucgccaacaaagguuugucuacgaugccuaccaaaaucuuguuggauauuauucggaugacgguaauuauuauugucuaagagccugcguuaguguaccaguaagcgucaucuaugauaaagaaacuaaaacccaugcaacacuuuucggaucagucgccugcgaacauauauccuccacgaugucacaauacucacgcuccacucgaucuaugcuuaaacgcagagauucaaccuacgggccacuacaaacaccaguaggaugcguucuaggucucguuaacucaucccuauuuguggaagauugcaaauuaccacuagggcaaucacuuugcgcuuuaccagauacccccaguacacucacaccauaa

SEQ ID NO: 2171 - RNA, 2244 nt, Artificial Sequence
  derived and/or modified CDS sequence (opt6) from MERS-CoV__AHY21469__S1
augauacauucagucuuucuuuuaauguucuuauuaacucccacagaaucauacguagauguaggaccagacucuguaaaauccgcuuguauugaaguagauauucaacagacauucuucgauaaaacauggcccagaccaauagauguaucuaaagcagaugguauuauauauccucaaggucgcacauacucuaauauuaccauaacauaucaaggguuauucccuuaucaaggcgaucauggggauauguacguauauagcgcaggacacgcaacuguaacaacaccucagaaacuuuuuguagcuaacuauucucaagacguaaaacaauuugcuaacgguuuuguaguccgcaucggagcugcagcgaacucaacagguaccguaauaauaucaccaagcacauccgcaaccauucgcaaaaucuacccugcuuucauguuaggcucaucaguagguaauuuuuccgacgguaaaaugggaagauucuuuaaucauacauuaguucuacuucccgacgguugcgguacacuauuacgcgcuuucuacugcauccuugaaccacgaucagguaauuauugcccugcugguaacuccuauacaucuuuugcaacuuaccacacccccgcaacugacugcucagauggaaacuauaauagaaaugcuucgcucaacagcuucaaggaauauuucaaucugagaaauuguacuuucauguacacauauaacauaacagaggaugaaauacuagagugguucggaauuacacagaccgcucaaggagugcauuuauucagcucaagauaugucgauuuauacggcggaaauauguuucaauucgccaccuuaccuguuuaugacacgauaaaauacuauucaauaaucccucauaguauacuauccauacaaucugaccgaaaagcaugggcugcauuuuacguauauaaauuacaaccucuaacauuucuauuagauuucucuguugacggcuauauacgccgugcaaucgauugcggauuuaaugaccucucacaacuccacuguuccuaugaaaguuuugauguggaaucugguguauauucaguuucgaguuuugaagcgaagcccuccggcuccguugucgaacaggcugaagguguugaaugugauuuuucuccucuucucucagguacaccuccgcaaguguacaauuucaaaagauuaguauucaccaauugcaauuacaacuuaacuaaauuacuuuccuuauuuucuguaaaugauuucacauguucacaaauaagcccugcugccauagcaucaaacuguuacucaucauuaauacucgauuacuuuucuuaucccuuaaguaugaaaucagauuuauccgucucuuccgcaggcccaauaucccaauucaauuauaaacaaucauuuucaaacccaacaugucuuauucucgcgacagucccgcauaauuuaacaacuauaacuaaaccacuaaaguauaguuauaucaacaaauguucacgauuauuaucagacgauagaacagaaguaccacaauuaguaaacgcuaaucaauacucacccuguguaucuaucguaccuucaacuguuugggaagacggagacuauuaccgaaaacaacucucaccgcucgaagguggggguuggcuaguagcaucaggcuccacaguagcaaugacagaacaguuacaaaugggcuucggaauaacaguucaauaugguacagacacuaacagcgugugcccaaaauuagaauuugcaaacgauacgaaaaucgcaucucaauuaggcaauuguguagaauacucacuauaugguguaaguggaagaggaguauuccagaacuguacagcaguaggaguaaggcaacaacgauucguauaugaugcauaucaaaacuuaguagguuauuacuccgaugauggaaauuacuauugucuaagagcaugcgucuccguuccuguguccgucauuuaugauaaagaaacaaaaacccacgcaacauuguuugguuccguugcuugcgaacauauaucuucuacuaugucccaauauucaagauccaccagaucuauguuaaaacgaagagacucaaccuauggucccuuacaaaccccuguaggauguguucucggauuaguuaacucuucccuauuuguugaagacugcaagcuaccucugggacaaucucucugugcuuuaccugauacacccuccacauuaacaccuuaa

SEQ ID NO: 2172 - RNA, 2244 nt, Artificial Sequence
  derived and/or modified CDS sequence (opt6) from MERS-CoV__AHZ64057__S1
augauacauuccgucuuccuauuaauguuccucuuaaccccuacagaaagcuacguggauguuggcccugauaguguuaaaucagccuguauagaaguugauauccaacaaacuuucuuugacaaaaccuggccccgcccaauagauguaucaaaagcagauggaauuauauacccacaagguagaacauacucaaacaucaccauaaccuaucagggacuuuuuccauaccaaggcgaucacggagauauguaugucuacucagcuggacaugccaccggcaccacaccacaaaaacuguuuguagcaaauuauucacaagauguaaaacaauuugcaaaugguuuuguagucagaauaggcgcagcagccaauaguaccggcaccguaaucauuucaccuucaacaucggcaacaauaagaaagauauacccugcuuucaugcugggcagcucugucgguaauuuuucagaugguaaaaugggccguuucuucaaccauacauugguacuacuucccgaugggugcgguacacuccuacgcgcuuuuuacuguauacuagaaccaagaucugguaaccauugucccgccgguaauucauacacaucauucgcuacguaucauacaccagcaacagacuguucagauggcaacuauaauagaaaugcaucccuuaacucauucaaagaauacuuuaaccuaagaaauuguaccuuuauguauacauacaauauaacugaagaugaaauauuagaaugguuugguauuacccaaacugcacaagguguucaucuauuuucaucaagauacguagaucucuacggugguaauauguuccaauucgcaacauuaccuguuuacgauacaauaaaauauuauaguauaauaccucauucaaucagaucaauccaaucugacagaaaagcaugggcugccuuuuauguauacaaacuacaaccacucaccuuuuuacuagauuucucaguagauggcuauauaagacgagcaauagauugcggauucaaugacuuaagccaacuacauuguucuuacgaaaguuucgauguagaaaguggaguguacucagucuccaguuuugaggcaaaaccauccggauccgucguagaacaggcugaagggguagaaugugacuucucgccauugcucucaggcacaccuccacaagucuacaacuuuaaaagacuugucuuuaccaauugcaauuacaaccuaacaaaacuucucagucucuuuucgguaaaugacuuuacuugcucucaaauuucuccagccgcgauagcaucaaacuguuauaguucacucauccuagauuauuucucauacccauugucaaugaaaucagaccuaagcgucagcuccgccggcccaauaagucaauucaacuacaaacaaucuuucucuaauccgacuugccuaauccuagcaacagucccccacaaucuaacaacgauaacuaaacccuuaaaauauucauauaucaauaaauguagucgcuugcucucagacgaccgaacugaggucccucagcuaguuaaugcaaaucaauauucaccuuguguuucaauuguaccuuccacuguaugggaagacggugauuacuauagaaagcaauuaucaccucuugaagggggaggcugguugguugcuucaggcagcacaguagcgaugacugagcaauuacaaaugggauucggaauaacaguacaauaugggacagacacgaacucuguaugucccaaacucgaauuugcaaacgauacgaaaauagcaucucaacugggaaauuguguugaauauagcuuauacggcguaucaggucgcggaguuuuucagaauuguacagcagucggcguacgacaacaaagauuuguuuaugaugcauaccaaaaccuaguaggauauuauucugaugacggcaacuauuacugcuuacgggccugugucucaguccccguaucaguuauuuacgauaaagaaacaaaaacacacgcaaccuuauuuggaucaguugcuugcgaacauauauuuagcacaaugucccaauauucacgcaguacuagaucaaugcuuaaaagaagagauucuaccuacggaccacuacaaacaccaguuggaugcguuuuaggacuuguuaauuccagcuuauuuguugaagacugcaaacuaccacucggacaaucacuaugcgccuuaccugacacaccaaguacccuuaccccauaa

SEQ ID NO: 2173 - RNA, 2244 nt, Artificial Sequence
  derived and/or modified CDS sequence (opt6) from MERS-CoV__AID50418__S1
augauucauagcguuuuucuucuaauguuccuacuuacaccaacagaaagcuacguagauguuggucccgacaguguaaaaucugcuuguauagaaguugacauacaacaaacauuuuucgauaaaacuuggccccgaccuauagauguuucaaaagcagacggaaucauauacccacaaggaagaaccuauucaaacaucacaauaacuuaccaaggccuuuucccuuaccaaggugaucauggcgacauguauguauauucugcgggucacgccacaggcacuacaccccaaaaacuauucgucgcaaauuauucacaagaugucaaacaauuugcuaauggauucguugugcgaauaggagcugcagcaaacucuacaggaaccguaauuauuucaccuucaacaagugccacuauaaggaagaucuacccagcuuuuaugcuuggcucaucaguugguaacuucucagaugguaaaaugggcagauucuuuaaccacacacuuguacuuuuacccgauggcuguggaacauuacuacgugcuuuuuacuguauuuuagaacccagaucugguaaucauuguccagcagguaacuccuacacuuccuuugcaacauaucauacccccgcaaccgacugcagcgacgggaauuauaauagaaaugcuucccuaaacuccuuuaaagaauacuucaaucuccgaaauugcacauuuauguauaccuacaacaucacagaagaugaaauucuagaaugguucggaauaacccaaacagcucaggguguacacuuauuuucaucacgauauguagauuuauacggcggaaacauguuucaguucgccacucugccugucuaugauaccauuaaauauuauucuauaauaccccacucaauaagaucaauccaaagugaucgaaaagccugggcagcauuuuaugucuacaaacugcaaccacuaacuuuucuacuugauuuuuccguugacgguuacauccguagagcuauugauuguggauucaaugauuuaucacaauuacauuguuccuaugaaucuuuugacguagaaucaggaguauacucuguaucuucauuugaagcaaaaccgucagguuccguagucgaacaagcggaaggcguagaaugugauuuuaguccccuuuuaagugguaccccuccccaaguauauaauuucaaaagauugguauuuacuaauuguaacuacaauuuaacaaaauuauuaucguuauucucaguuaacgacuucacaugcucacaaaucuccccugcugcuauagcaaguaauugcuauagcucacuuauacuugauuacuuuuccuacccgcucaguaugaaaucagaucuauccguuucuucagccggccccauaagucaauucaauuauaaacaaucauucagcaacccaacaugucuaauccuagcuacaguaccucauaaucuaacaacaaucacaaaaccccuaaaauauucuuauauaaauaaauguagccgauuacuaagcgaugacagaacagaaguaccucaauuaguuaaugccaaccaauacaguccauguguauccauaguuccaaguaccguaugggaagacggagauuacuaccgaaaacaacuaucuccccuugaaggcggaggcuggcuaguagcuaguggcucaaccguagccaugacagagcaacuccaaaugggcuuugguaucacgguacaauacgguaccgacacaaacagcguauguccaaaauuagaguucgccaaugauaccaaaauagcaucacaauuaggcaauugcguugaauauagcuuauaugguguaucuggaaggggaguauuccagaauugcacagcugucggcguuagacaacagcguuuugucuacgacgcauaccaaaauuuagucgguuacuacagugaugauggcaacuacuacugccuaagagccugugucucaguaccaguuucaguuauauaugauaaagaaacaaaaacccacgcaacacuauucggauccguagcaugcgaacauauuaguucgacgaugucacaauauucgagaucaaccagaucuaugcuuaaacgacgagacucaacuuacggaccacuacagacaccuguuggcugcgucuuaggccucguaaauaguucuuuauuuguagaagauuguaaacuuccacuugggcaaucucuuugcgcacuccccgauaccccuucaacccucaccccauaa

SEQ ID NO: 2174 - RNA, 2244 nt, Artificial Sequence
  derived and/or modified CDS sequence (opt6) from MERS-CoV__AID55068__S1
augauacacaguguauuccucuuaauguuucucuuaacaccuaccgaaucauacguagacguaggcccugauucgguaaaaucugccuguauugaaguugauauacaacaaacuuucuuugacaaaaccuggccucggccaauugauguaucuaaagcagaugggauuauauauccgcaaggucguacuuauucaaauauaacaauuacuuaucaaggccuuuuuccauaccaaggagaucacggcgacauguaugucuauucagcaggucaugccacuggaacaacaccccaaaaacuuuucguugcgaacuacucucaagauguaaaacaauucgcaaacgguuuuguaguucgaauaggugcagcagccaauucuacagguacaguaaucaucucuccaucaaccucugcaaccauccguaaaauauauccugcauucauguuaggaucuucaguugguaacuucagugauggcaagauggggcgcuucuucaaucauacucucguauuauuaccugacggcugcggcacacuauuaagagcauucuauuguauucuugaaccacgaucggguaaccacugucccgcuggaaacucuuauacgucauuugcaacuuaccacacacccgcgacagauugcuccgauggaaacuauaaucgcaaugcaucucuaaauuccuuuaaagaauauuucaauuuaagaaacugcacuuuuauguacacauauaauauuacagaagaugaaauucuugaaugguucggaauaacccaaacagcucaaggaguacaucuauuuucgucaagauacgucgacuuauacggcggaaacauguuccaauuugccacccuucccguauaugacaccauuaaauauuauuccaucauaccacauucuauaagaucaauacaaagcgaccgaaaagccugggcugcguuuuacguauauaaacuacaaccucucaccuuucuacuugauuuuucuguugauggauauauucggagagcaauagauugcgguuuuaacgaucuaagucaacuccauugcucuuaugaauccuuugacguagaaagcggaguuuauucaguaaguucauuugaagcaaagccuagugguuccguuguugaacaggcugaaggaguagagugcgauuucucacccuuauuaucaggaacaccaccacaagucuacaauuuuaaacgauuaguauucaccaacugcaauuauaaucuaacaaaauuauuaucacuauuuaguguaaacgauuuuacauguucacaaauaaguccugcagccauugcuuccaauuguuauaguucuuuaaucuuagauuauuuuuccuauccuuugagcaugaaaucugauuuaaguguuaguagugcaggucccaucucgcaauucaauuauaaacaaucauuuuccaauccaacaugucuuauacucgcuaccguuccucauaaccucacuacaauaacuaaaccuuuaaaauacucauacauaaauaagugcucaagacuucuaucagacgacagaacagaaguaccccaauuagucaaugcaaaccaauauucgccguguguauccauugucccaucaacuguaugggaagauggagauuauuaccgaaaacaauuaucuccccucgaaggaggaggcuggcuaguagcguccgguagcacaguagcaaugaccgaacaacuccaaauggguuucgguauaacuguacaguauggcacugauacaaacucaguaugucccaaacucgaauuugccaaugacacaaaaauugcaucacaacuuggcaacugcguugaauacucacuauauggagucucagggcgaggaguuuuccaaaacugcacugccguaggaguacgacaacaacgauuuguauaugaugcauaccagaaucuaguuggcuacuauucagacgauggcaacuauuacugccuacgagcuuguguuucagucccugucucaguaauauacgacaaagaaacuaaaacucaugcaacacuauucggcaguguggcuugugaacacauaagcaguaccaugucccaguauucuaggaguacacguuccaugcuuaaacgacgugacaguacauauggaccauuacaaacaccaguuggauguguauuaggucuaguuaauucaucacuuuucgucgaagauuguaaacuuccauuaggccaaucuuugugugcacuacccgauacaccaucaacacucacuccauaa

SEQ ID NO: 2175 - RNA, 2244 nt, Artificial Sequence
  derived and/or modified CDS sequence (opt6) from MERS-CoV__AID55073__S1
augauucauucaguauuucugcuaauguuucuucuaacaccaacugaaucuuacguagacguaggaccugauuccguaaagucagccuguauugaaguagacauucaacaaacuuucuuugacaaaaccuggccaagaccaauugacgucucaaaagcugacggaauaauauauccccaagguagaaccuauaguaauauaacuauaacuuaccaaggauuauuuccuuaccaaggcgaucacggagacauguauguauacucugccgggcacgcaaccgggaccacaccucaaaaguuauuuguggcaaacuauucucaagauguuaaacaguuugccaauggauuugucguuagaauaggugcagcugcaaauucaacagguaccgucauaauuucuccauccacuucugcuacuauacgaaaaaucuacccugcauucaugcuaggaucaucuguuggcaacuucuccgacgguaaaaugggacguuucuuuaaucacacauuaguucuacuacccgacgguugcggaacucuacuuagagcauuuuauuguauacuugaacccagauccggaaaucauugcccagccggcaacaguuacacaucauuugccacauaccauacuccagcaaccgacugcagugauggcaauuacaauagaaacgcaucucuuaacucauuuaaagaauacuuuaauuuacguaacuguacuuucauguacacuuauaacauuacagaagaugaaauuuuagaaugguuuggaauaacacaaacugcucaaggugugcaucuauucuccucccgauacguagaucuauacggaggaaacauguuccaauucgcaacacuaccaguauaugacaccaucaaauauuacucuaucauaccccauagcauucguucuauucagucagaucgcaaggccugggcagcauucuacguauauaaacugcaaccuuuaacauuccuacuugacuuuucaguagacggauacauucguagagcaauagauugugguuuuaacgauuuaucucaacuucauuguucguacgaauccuucgauguagaaucuggaguuuauucaguaagcucauuugaagcaaaacccucgggaaguguugucgaacaagccgaagguguugagugcgauuuuucaccauuguuaucuggaaccccuccgcaaguauauaauuuuaaacguuuagucuuuacaaacuguaauuauaacuucacaaaacuacuaucacuuuucucuguaaacgacuucacuuguucccagauaucuccagccgcaauagcaucgaacuguuacucaucuuuaauacucgauuauuuuucauauccacucagcaugaaaucagauuuaucuguuaguuccgccgguccaauaucacaauuuaauuacaaacaaucauuuuccaacccuacuugucugauucuugccacaguaccgcauaaucuaaccacuauaacaaaaccacuaaaauacuccuacaucaauaaaugcucccgcuuacuuagugacgaccgaacagaaguaccacaacucgucaacgcaaaucaauacucgcccuguguaucaaucguuccuucuacaguaugggaagacggugauuauuaucgaaaacagcuaucuccccuagaaggaggggguuggcuuguagcaagcggaagcacaguugcaaugaccgaacaacuucaaaugggauuuggaauuacaguacaauacggaacugauacuaacagcguaugcccuaaacuagaguucgccaacgacacaaaaauagcaucacaacucggaaacuguguagaauacucccuuuacgguguguccggaagaggagucuuucaaaacuguacugccguaggcgucagacaacaacgcuuuguuuacgaugcguaccaaaacuuaguagguuacuacucugaugacggaaauuauuauugccuuagagcuuguguaucuguacccguuagugucauuuacgauaaagaaacgaagacccacgcuacauuguucggcagugucgcaugugaacauauuuccucuacgaugucacaauacucuagaucaacccgaaguauguuaaaaagaagagauuccaccuauggaccccuacaaacuccagucgguuguguuuuaggccuaguaaacucaagccuauucgucgaagauuguaaauuaccuuuaggacaaagccuaugcgcauuaccagauaccccuagcacgcuaacuccauag

SEQ ID NO: 2176 - RNA, 2244 nt, Artificial Sequence
  derived and/or modified CDS sequence (opt6) from MERS-CoV__AIY60528__S1
augauacacucgguauucuuauuaauguuccuucuaacuccaaccgaaagcuauguugacguuggaccagauucuuuuaagucagccugcauugaaguugauauucagcaaacauucuuugauaaaaccuggccucgaccaauagacgucaguaaagcagauggcauuauuuacccccaagguagaacuuauucuaauauaacaaucaccuaucaaggacuauucccuuaccaaggcgaccacggggacauguauguauacucagcaggucacgcuaccggaacuacaccacaaaaauuauucguagccaacuauagccaaaauguaaaacaauuugcaaacggauuuguagucagaauaggugccgcggccaauuccacagguacagugauaauaagcccauccacuucagcuaccauucguaaaauuuauccagcauucaugcuaggcucuagugugggcaauuuuagugauggaaaaaugggcagguucuuuaaccacacgcuuguccuccuaccugaugguugcggcacacuacuucgugcguuuuacugcauauuagaaccaagauccggaaaccacuguccagcagguaauucauauacaucuuuugcuacauaccauaccccugcgacagauuguuccgacggaaauuauaauagaaacgcaucucuuaauuccuuuaaagaauacuucaaccuacguaauuguacauucauguacacauacaacauuacagaggaugaaauucuagagugguuugguauuacacaaacugcccaagggguacaccucuuuuccuccagauauguagaucuuuauggaggaaacauguuucaauuugcuacccuaccagucuaugauaccauaaaauauuacuccauaauaccucauagcauccgcucuauacaauccgaucgaaaagcaugggcagcauuuuacguuuacaaacuccaacccuuaacauuuuuacucgacuuuucuguagauggcuacauccgccgggcuauagacugcggauuuaaugaucucagucaacuacauugcucuuacgagucauucgacguugaaucuggaguauauucagucagcuccuuugaagcaaaaccuucaggaucaguagucgaacaagcugaaggcguagagugcgauuuuucuccccuacuuuccgggacaccaccucaaguauauaacuucaaacgauuaguuuuuaccaauuguaauuauaaccuaaccaaauuacucucuuuauucuccguaaaugacuuuacaugcucacagauauccccagcagcuauugcuaguaacugcuacucuucacuuauacuggauuacuuuagcuaucccuuaucaaugaaaagcgauuuaucuguauccucagcuggaccuauaucucaauuuaacuacaaacaauccuuuaguaauccaacgugucuuauucucgcgacagugccucauaaucuaacaacgauaacaaaaccacuuaaguacucauauauuaauaaaugcucaagguuacuaucugaugaucgaacugaaguaccucaacucguaaaugccaaucaauacagcccaugcgucaguauuguaccaucuacuguaugggaagauggugacuauuacagaaaacaacuuucaccauuagaaggaggcggauggcugguugcuaguggaucaacugucgcaaugacugaacaacuacaaauggguuucgguauaacaguccaauauggaaccgacacuaacucaguuugcccaaaacuagaauuugcaaaugauacuaaaauugcaucacaauuggguaacuguguugaauauucacuuuacggcguuucaggacggggcguguuucaaaauugcacugcaguugguguaagacaacaacguuucguauaugacgcauaucaaaaucuuguaggguacuauucagaugacgguaacuacuacugucuucgagcuugcguaucaguacccguuucagucauauaugauaaggaaacuaaaacacacgcaacucuauucggcucaguugccugcgaacauauaaguucaacuaugucacaauacucacgcucaacaagauccaugcucaaaagaagagauuccacauauggcccacuccaaacaccaguuggaugcgucuuaggucuaguaaauuccucacuauuuguagaggauugcaaauuaccacuaggacaaucucucugcgcauuaccagauacacccucuacauuaacgccauag

SEQ ID NO: 2177 - RNA, 2244 nt, Artificial Sequence
  derived and/or modified CDS sequence (opt6) from MERS-CoV__AIY60558__S1
augauacauucugucuuccuucuaauguuucuauuaacuccuacggaaucuuacguugauguagggccugauagcuuuaagucagcauguauagaaguugacauacaacaaacuuucuucgauaaaacauggccuagaccaauagaugugucuaaagcugacggcauuaucuauccacaaggcagaaccuauucaaauauuaccauuacuuaucaaggccuauucccuuaucaaggugaccauggcgauauguauguuuauagugccggccaugccacaggaacaacaccucaaaaauuauucguugcaaacuauagccaagauguuaaacaauuugcaaacggcuuuguaguaaggauaggagcugcugcaaauucaacggguaccguuauaaucucaccaaguacaucugcgaccauuagaaaaaucuacccugcauucaugcuaggaucaucuguuggcaauuuuagugauggaaaaaugggaagauuuuucaaucauacacuuguuuuacucccagacggcugcgguacauuauuacgcgcauuuuacuguauuuuagaaccacgaucaggcaaucauugcccagcaggcaauucuuauaccagcuuugcaacguaucauacgccugcaacagacugcuccgacggcaauuacaacagaaaugccucacuuaauucauucaaagaauacuucaaucuacguaacuguaccuuuauguacacauauaauaucacagaagaugaaauucucgaaugguucggaaucacucaaacggcacagggaguucaucuuuucagcucgcgcuacguagacuuauauggcggaaauauguuucaguuugccacucuuccagucuaugauacaauuaaauauuacucuauaauuccacacuccauccgaucaauacaaucugauagaaaagcaugggcugcauuuuaugucuauaaguuacaaccucucaccuuucuuuuagacuuuucaguagauggauauauacguagagcuauagacugcggcuuuaacgaccugagucaauuacacuguagcuaugaguccuuugacgucgaaucaggcgucuacucaguaucuucauucgaagcaaaaccaucaggaagcguuguagaacaagcagaaggaguagaaugugauuucucgccuuuacuaucgggaacacccccgcaaguuuauaauuuuaaacgccuaguuuuuacuaauugcaauuauaaucuaacaaaauuauuaucucuuuucuccguaaaugacuuuacauguucucaaauaucaccagcagcaauagcuucaaacugcuauucaagucuaauccuggauuauuuuucauacccauuaucaaugaaauccgaucuaucaguauccucugcuggcccaaucagccaauucaacuauaaacaaucauucucaaauccaacgugccuaauuuuagcaacagucccucacaaccucacaaccauuacaaaaccauuaaaauauagcuacauaaacaaaugcucuagauuacuaucugaugauaggacugaagugccacaacugguaaaugcaaaccaauauaguccauguguaucaauaguaccuagcacaguaugggaagacggcgauuauuaucgaaaacaacuuuccccauuagaaggaggaggcuggcucgucgcaagcggaucaacuguugccaugacugaacaauugcaaaugggauucgguauaaccguccaauauggaaccgacacaaauuccgucugucccaaauuagaauuugcaaacgacaccaaaaucgcaucacagcuugggaauugcgucgaguauucucuauacgguguauccggaagaggaguauuucaaaauugcacagcagucggaguaagacaacaacgcuuuguauaugacgcauaccaaaaccuuguaggauacuauucagaugauggaaacuauuauuguuuaagagcaugcguauccguucccguaucaguaauauaugauaaagaaacaaaaacucaugccacguuauucgguagugucgccugugaacauauuaguucaacaaugucucaauauucuagguccacacgaucaaugcucaaacgacgugauucuacauacgguccucuucaaacaccaguugguuguguacuaggccuuguuaauuccucccucuucguugaagacuguaaacuuccccucggucagucccuaugugcgcugcccgauacuccaucaacacuuaccccauag

SEQ ID NO: 2178 - RNA, 2244 nt, Artificial Sequence
  derived and/or modified CDS sequence (opt6) from MERS-CoV__AIZ74450__S1
augauucauaguguauuucuacuuauguuuuuacucacuccaacagaauccuacgucgauguaggccccgacucuguuaaaucugcuugcauugaaguugauauccaacagacauuuuucgauaaaaccuggccacgcccaauugacgucaguaaagcugauggcaucauuuacccacaagguagaaccuauaguaacauaacaauaacauaucaaggguuauucccauaucaaggagaucacggugauauguacgucuacagcgcaggacaugccacaggaacuacaccacaaaaacuauuuguagcaaacuauucacaagaugucaaacaauuugccaauggauucgugguaagaauuggagcagcagcuaacucaacugggacagucauaauuucgccaucaacaagcgcaaccauaagaaaaauauauccugccuucauguugggauccucagugggaaacuuuucagaugguaaaaugggccgauuuuucaaucauacucuaguauuacuuccagauggaugcgguacacuacuacgagcuuucuacuguauauuagaaccuagaucuggaaaccacuguccggcuggaaacuccuauacaucuuuugcuacuuaccauacaccagcaacagauuguucugacggaaauuacaaucgaaaugcaagccuaaauagcuuuaaagaauacuuuaaccugcguaauugcaccuucauguacacauauaauauaacagaagaugaaauauuagaaugguucggcauaacacaaacagcgcaaggaguacaucucuuuucaucuagauauguagaccuuuaugguggaaacauguuccaauucgcgacccucccuguauacgauacuaucaaauacuauaguaucauaccccauaguauucgauccauacaaagcgaucguaaagcaugggcagcauucuacguauauaaacuacaaccuuuaacauucuuacuagauuuuaguguggaugguuacauccgacgcgccaucgacugcggauuuaaugaccuaucacagcuccauugcagcuacgagagcuucgacguugaaaguggaguauauuccguaaguucauuugaagcaaaacccuccggaucaguaguugaacaagcagaagguguagaaugcgauuuuuccccucuauuaucaggaacuccuccucaaguuuacaauuuuaaaagauuaguuuuuacuaauugcaacuauaaucucacaaaauuauuaucucuauucucaguuaaugauuucacgugcucucagauuaguccagcagccauugcaucaaauuguuacucaucccuuauucuagauuauuuuucauaucccuuaucuaugaaaucagaucuaaguguuaguuccgcaggcccuauaucacaauuuaauuauaaacaaucuuucucaaauccaacaugucuaauauuagcaaccgucccacacaaccuaacaacaaucacaaaaccgcucaaauacagcuacauaaauaaauguucacgacuuuuaagugacgaucguacugaaguuccccaacuuguaaacgccaaucaauauucacccugcgucucgauuguuccaucaacugucugggaagacggagacuacuacagaaaacaauuaucuccucuugaaggugguggaugguuaguagccucgggaucuacuguagcaaugacagaacaauuacaaaugggguuuggaaucacaguccaauaugguacagacacaaacucagucuguccaaaauuagaauuugcuaaugacacaaaaauagccucccaauuagguaacugcguagaauacucucuauacggaguauccggaaggggaguauuucaaaacugcacagcagucggaguuagacaacaacgcuuugucuaugaugcauaucaaaaccuagucggguauuauucugacgauggaaauuauuacugcuuaagagcauguguaagcguacccguauccguaauauaugauaaagaaacaaaaacacacgccacacuauuuggaagugucgcaugugaacacauaucuuccaccaugucacaauauucacgauccacaagaucaaugcuaaaacgaagggacaguacuuauggcccccuacaaacaccuguugguugcguacuugguuuagucaacucgucuuuauuuguugaagauugcaaauuaccacucggucaaucccucugugcuuuaccagauacuccaucuacucucaccccuuag

SEQ ID NO: 2179 - RNA, 2244 nt, Artificial Sequence
  derived and/or modified CDS sequence (opt6) from MERS-CoV__AJD81440__S1
augauacacuccguuuuucuacuaauguuucuacuaacaccaaccgaaucuuauguagauguagguccugauagcgugaaaagcgccugcaucgaagucgauauacaacaaaccuucuuugauaaaacuuggccaagacccauagacgucuccaaagcugacggaauaaucuacccccaaggucggacauauagcaauauuacuauaacuuaccaaggacuuuucccauaucaaggcgaucauggagauauguacguauacucugcuggacaugccacaggaacaacuccacaaaaacuuuucguggcaaauuauucacaagauguuaaacaauuugccaauggauucguugugagaauuggugcggccgcaaacuccacuggaacaguuauaauuaauccaucaacaagcgcaacuauucguaaaauauauccugcuuuuauguuaggauccucuguagguaauuuuagcgauggcaaaauggguagauucuuuaaccauacacuuguauuacuuccugaugguugcgguacacuauuacgagccuucuauuguauuuuagaaccucguucaggaaaccacugcccagcaggcaauucuuauaccucauuugcuaccuaucacacaccagcaacugauuguucagaugguaauuacaaucgcaacgcuucucuuaauaguuuuaaagaauauuucaauuuaagaaacuguacuuuuauguacaccuauaauauaacagaagaugaaauacuagaaugguucggcauaacucaaacagcgcaaggaguacacuuauuuuccucacgauauguagaucuguauggcgggaacauguuucaauuugcuacucuaccagucuacgacacaauuaaauauuauucaaucauaccucauaguauucgaucuauacaaucagaccgcaaagccugggcagcuuuuuacguuuacaagcuacaaccucuuacauuccuccucgacuuuucagucgauggcuauauuagacgagcuauagauugcgguuuuaacgaccuaucgcagcuacauuguuccuaugaauccuucgauguagaaagugguguauauuccguaagcaguuuugaagcuaaaccaucugguucaguaguugaacaagcugaaggaguagaaugugauuucucaccauuauuaucaggcaccccuccucaaguauacaauuucaaacgucucgucuuuacuaacuguaauuauaaucuuacaaaacuacugucucuauuuuccguaaaugauuuuacaugcucacaaauauccccugcggcaauagcuucaaauuguuacagcagcuuaauauuagacuauuuuucuuauccacuuuccaugaaauccgaccuuucaguaucuucagcagguccaauaagucaauuuaauuacaaacagucauuuucaaauccaacaugucuaauuuuggcaacugucccucauaaucuaacuacuauaacaaaacccuuaaaauauucauauauaaacaagugcagcagacucuuaucagaugaccgcacugaaguaccacagcuugucaacgcaaaucaauauucaccuugcgugaguauuguaccaucaacugucugggaagacggagacuauuacagaaaacaauuaucaccccuagaggguggagguuggcugguugcuucagguagcacagucgcuaugacagagcaguuacaaaugggcuuugguauaacaguucaauacgguacagauaccaauuccguguguccuaaacuagaauuugcaaaugauacaaaaauagcuucacaacuaggaaacuguguugaauauucacuauauggaguuucaggaagaggcguuuuccaaaauuguacugcugugggcguuagacaacaacguuucguuuacgaugcauaucaaaaccucguaggauacuauuccgaugacggaaauuacuacugccuucgagcaugcguuucaguacccgucucaguaauauacgacaaagaaaccaaaacacaugcaacucucuucggcuccguugcaugcgaacacauauccucuacuaugucacaauacucacggucaacuagaucuauguuaaaacguagagauuccacauauggcccauuacaaaccccugucggauguguuuuagguuuaguaaacucaucucucuuugucgaagacugcaaacuuccacuuggucaaucacucugcgcauuacccgauacaccaaguacauuaacaccauaa

SEQ ID NO: 2180 - RNA, 2244 nt, Artificial Sequence
  derived and/or modified CDS sequence (opt6) from MERS-CoV__AKI29284__S1
augauccauuccguuuuucuauuaauguucuuauuaacuccuacagaauccuacguagauguuggacccgacagugucaaaagcgcaugcaucgaaguugacauacaacaaacauucuuugauaagacauggccaagaccaauagauguauccaaagcagacgguauaauauacccacaaggaagaaccuacucaaacauaacaauaacauaccaaggauuauuuccauaccaaggcgaucauggggacauguauguuuauuccgcagggcaugcuacugguacaaccccacaaaaacuuuucguugcgaauuauucccaagauguaaaacaauuugcuaaugguuucgucgucagaauuggagcagcagcuaauuccacaggcaccgucaucauaucuccaaguacuuccgcaacaauccgcaaaauuuauccagccuucaugcucgggucaucuguaggaaauuucagugaugggaaaaugggaagauucuuuaaccauaccuuaguacuucuuccagacggcuguggcacucuauuaagagccuucuauuguauauuagaaccacguucaggcaaucacuguccagcagguaauagcuauacaucauucgcaacauaccacaccccagcaacugacuguagugauggaaacuauaaccgaaacgcaagucucaacuccuuuaaagaauauuuuaacuuaagaaacugcaccuuuauguauacuuacaauauaacagaagaugaaauacuagaaugguucgguauaacacaaacugcacaagggguucaccuuuuuagcucaagauauguugaccuauauggcggcaacauguuucaauucgcaacacuuccuguauaugauacuauaaaauauuacucaaucaucccacauaguauaagaucuauucaaucagaucgaaaagccugggccgcuuucuauguuuauaaauugcaaccacuuaccuucuuacuagacuuuuccgucgacggauacauccgacgcgccauagacugcggauuuaaugacuuaucacaacuucauugcucauacgaaucauuugacguugaaucuggcgucuauagcgucucaucauuugaagcaaaaccaucuggcucuguagucgaacaagcugaagguguagaaugcgacuucucaccauuacuuucaggaacgcccccacaagucuauaauuucaaacgauugguauucacuaauugcaauuauaaccuaacaaaacuacuaucacuauuuagugucaacgauuucaccuguucucaaauaagccccgcugcaauagcaucgaacuguuauucuucacucauacuagacuauuuuuccuauccauuaucgaugaaaucagaucuuucaguuucaucagcaggaccaauaucacaauucaacuauaaacaaucauuuuccaauccuacaugucuaauucuugccacuguuccacauaaucugaccacuauaacaaaaccucuaaaguauucuuacaucaacaaauguucccgucuacucucagacgaucguacagagguaccucagcuagucaacgccaaucaauacagucccugugucucgauaguaccuucaacugucugggaagacggagacuauuauagaaaacaauuaucaccauuagaaggaggagguuggcuuguugcguccggaucuacaguagcaaugacagaacaauugcaaaugggauucgguaucacuguucaauacggaacugacaccaauucaguaugcccaaaacuagaguucgcaaacgauacaaaaauugcaucacaacuggguaauugcgucgaauauagccuuuauggggucucuggucgaggaguuuuucaaaauuguacagccguaggcgugagacaacaaagauucgucuacgacgcuuaucagaaucuaguuggauauuauagugaugacggcaacuauuacugucuucgagcuugcguaucagucccgguuucaguaauauaugacaaagaaacuaaaacucaugcaacacuuuucggaucuguagccugugaacacauaucaucuacaaugucacaauacucacgaucaacucgguccauguuaaaacgucgagacuccacauacgguccacuacaaaccccagucggaugcguacuuggucuuguaaacucaucguuauuuguugaagauugcaagcuaccacucggacaaagccuuugugcacuacccgauaccccaucuacacucacacccuaa

SEQ ID NO: 2181 - RNA, 2244 nt, Artificial Sequence
  derived and/or modified CDS sequence (opt6) from MERS-CoV__AKL59401__S1
augauacacaguguauuccuguuaauguuuuuacuaacacccaccgaaucauauguugaugugggaccugauagcgugaaaagugccuguaucgaaguagacauacaacaaacuuucuuugacaaaacauggccuagacccauugacgucuccaaagcagauggaauuaucuacccacagggacgaacuuacucaaauaucacaauaacauaucaaggauuauuccccuaccagggagaucauggagauauguauguauacucugcgggacacgcuacgggaacgaccccacaaaaauuauuuguugccaacuauucucaggacgucaaacaauuugcaaacggauuugugguucguaucggagcggcagcaaauuccacaggaacuguaauaauaucaccguccacccgagccacaauccgaaaaauauauccugccuuuaugcucggaucaucaguuggaaacuuuucugauggaaaaauggguagauuuuucaaucauaccuuagugcucuugccagauggauguggaacauuauuaagagcauucuauuguaucuuagaaccaagauccggaaaucacugcccagcuggaaauucauacacaucauuugcuaccuaucacacuccagcaacagauugcucagacggaaacuacaacagaaaugccucauuaaauucauuuaaagaauauuucaacuuaagaaauugcacguuuauguauaccuacaauauaacagaagaugaaauauuagaaugguuuggcaucacacaaacugcccagggaguucauuuauucucaaguagauacguagauuuauauggaggaaacauguuucaguuugcuaccuuaccaguuuaugauacuauaaaauacuacucaauuaucccucacuccauuagaucaauacaaucugauagaaaagccugggccgccuucuacgucuauaaacuucaacccuuaacuuuccuucuagauuucucugucgauggcuacauacguagagcaauagauuguggcuucaacgaucuaucccaacuacauuguucuuacgaaucauucgacgucgaaucuggaguguacucuguaucuucauuugaagcuaagccaucuggaucuguugucgaacaagcagaaggaguagaaugcgauuuuuccccauuauuaucuggcacacccccucagguauauaacuuuaaaagauuaguuuucacuaauugcaauuauaauuuaacuaaacuucuaucauuauucagcguaaacgauuuuaccugcagucaaaucucaccagccgcaauagcaagcaacuguuauucaagucuaauacucgauuauuucaguuacccacuaucgaugaaauccgaucucucuguuucauccgcgggacccauaucucaauuuaauuauaagcaauccuuuaguaauccaaccugucugauuuuagcuacaguaccacauaauuugacuacaaucacuaaaccccuuaaauacucauauauuaauaaaugcucacgauuacuuucugaugauagaaccgaagucccacagcuaguuaaugcgaaccaauacucccccugcgugucaauauuaccuaguaccguuugggaagacggagacuauuacagaaaacaauuauccccauuagaaggcggaggaugguuagucgcuagugggucaaccgucgcuaugaccgaacaacuacagauggguuuuggaauaacuguacaauauggaacugacacaaauaguguuugucccaaacuagaauuugcaaacgauacaaaaauagcaucucaauuagggaauuguguagaauauucucuuuacgguguuaguggacgaggcguauuccaaaacuguacagcuguaggaguacgacaacaacgcuuugucuacgacgcguaccaaaaccuugucggauauuauucagacgauggaaauuacuacuguuuacgugcaugcguaucaguaccaguaucuguaauuuaugauaaagaaacaaagacgcacgcaacauuauuuggauccguugcaugcgaacauauaucaucaacaaugagccaauacucuagaucuacaagauccauguuaaaacgcagagacuccacauacggcccacuucaaacaccggucggaugcguacuaggccuagucaacucauccuuauuugucgaagauuguaaacuucccuuaggacaaucauuaugugcccuaccagauaccccaaguacuuuaacgcccuaa

SEQ ID NO: 2182 - RNA, 2244 nt, Artificial Sequence
  derived and/or modified CDS sequence (opt6) from MERS-CoV__AKM76229__S1
augauacacucagucuuccuacuuauguuuuuacucacccccacagaaucuuacgucgaugucggucccgauaguguaaaaucagcauguauagaaguugacauacaacaaacuuucuuugacaagaccuggccucgcccaauagauguaaguaaagccgacggaaucauauauccacaagguagaacauauaguaauauaaccauuacauaucaaggauuauuuccuuaucaaggugaccauggugauauguacguauauucagcaggacacgcuacaggcacaacaccacaaaaacucuuuguagcaaacuacucccaagacguaaaacaauucgcuaauggcuuuguuguacgaauuggagcagcagccaauucuacaggcacaguaauuauaucuccuucaacaagugcgacuauaagaaaaauauacccagccuuuauguuaggaucauccguuggaaacuuuagugauggcaaaaugggucguuucuuuaaucauacucuaguauuacuuccagauggaugcgggacucuguuacgagcauuuuacuguaucuuagaacccagaagcggcaaccauuguccagccgggaauagcuauacaucauuugccaccuaccauacuccugccaccgauuguagugauggaaacuacaauaggaaugcguccuuaaacucauuuaaagaauauuuuaaccucaggaauugcacauucauguauacauacaacauaacagaagaugaaauacuagaaugguucggaauaacgcaaaccgcacaaggaguucaucucuuuucaagucgauauguugauuuauaugguggcaacauguuucaauuugccacacuuccaguauaugauacaaucaaauacuacucaauaaucccacauaguauuagaucuauucaaucugauagaaaggcuugggcggcauuuuacguauauaaacuccagcccuuaacuuuucuccuugacuucucuguagaugguuauauaagacgcgcgauagauugcggauuuaaugacuugucccaauuacacugcucuuaugagagcuuugauguagaaucagguguuuauuccguuagcucauuugaggcaaagccaucuggcucagucguugaacaagcagaaggcgucgaaugugauuuuucaccauuacuuuccgguacuccuccacaaguauauaauuuuaaacgucuaguauucacaaauuguaacuauaaucuaacaaaauuauuaucacuauucagcguaaacgacuucacuuguagccaaauaucuccagccgcaauagcuagcaauuguuacucaucacugauucuagauuacuuuaguuacccucuaucaaugaaauccgaucuuucuguuagcucugccgguccaauuucccaauucaauuacaaacaaucuuucucaaauccaacaugcuuaauauuagcaacaguuccucauaaccuuacaacaaucacuaaaccuuuaaaauacagcuacauaaauaaauguucaagauuauuauccgaugauagaacagaaguaccucaauuagucaaugcaaaucaauauagcccuugcgucuccaucguuccuucaaccguuugggaagacggagacuauuaccgaaaacaacucagcccucuagaggguggaggauggcuuguagcgucuggaucaacaguugcaaugaccgaacaacuacaaaugggcuuuggaauaacaguacaauacggcacagauacuaacuccgucuguccaaaauuagaauuugcaaaugacacaaaaauagcuucucaauuaggaaauugugucgaauauucacucuaugguguaucaggaaggggaguauuucaaaauugcacagcuguuggaguucgucaacaacguuuuguuuaugacgcuuaucaaaaucuagucggauauuacagugaugacggcaacuauuauugucuacgugccugugucucagucccaguaaguguaauauacgacaaagaaaccaaaacacacgccacacuuuuuggaucuguagcaugugaacacauaagcuccaccaugucccaauauucaagaucaacuaggucaauguuaaaaagaagagauuccaccuaugguccacuacagacaccaguaggauguguacuuggcuuaguaaauucaucuuuauuugucgaagacugcaaacugccucuuggacaaucauugugugcguugcccgauacaccuuccccauuaacuccauaa

SEQ ID NO: 2183 - RNA, 2244 nt, Artificial Sequence
  derived and/or modified CDS sequence (opt6) from MERS-CoV__AKM76239__S1
augauccacucaguauucuuauuaauguuucuucuaacuccgacggagucuuauguggaugucgguccagacucagucaaauccgcguguauagaggucgacauacagcagaccuucuuugauaaaacauggccccgcccaaucgacguaaguaaagcagauggaaucauauauccucaaggaagaacuuauucgaacauaaccaucacuuaucaaggucuauuucccuaccaaggcgaccauggugacauguaugucuacucugcaggacacgcgacagguacaacaccccaaaaauuauucguagcuaacuacucacaagaugucaagcaauucgcaaauggauucguaguacguaucggagcagcagccaacucuacuggcacggugauuauaagcccauccaccucagcaacuauccgcaagauuuacccugcauucaugcuaggcucaucaguagguaauuucagugauggcaaaaugggaagauucuuuaaccauacccuaguacuccuuccagacggcuguggaacacuucuaagagcauuuuacuguauucucgagccuagaucaggaaaccacugcccagccggaaauaguuauacaucauuugcaacauaccacaccccagcuacagacugcucagaugguaacuauaacagaaaugcaucacuaaacucauuuaaagaauauuucaaccuucgcaauugcacuuuuauguauacauauaauauaacagaagacgaaauacucgaaugguucggaauaacccaaacggcacaaggaguacacuuauuuagcucaagauacguagaccuauacggaggaaauauguuccaauuugcaacccuuccuguuuaugacacaauaaaauacuacucaauuauaccccauucaauucgcucaauacaaucagacagaaaggcuugggccgcauuuuauguuuauaaauuacaaccacucacauucuuacuagacuucucagucgacggauauauaagacgagcuauugacugcggcuucaaugaccuuucccaacuucacuguucguaugaaucauucgacguagaaucaggaguauauagugucucaucguucgaagcuaaaccaaguggcucaguaguugaacaagcugaaggaguugaaugcgauuuuucaccucuucuuucuggcacaccuccacagguauauaauuuuaaaagauuaguuuucaccaacuguaauuauaaucuuacaaaacugcuaucucuauuuaguguaaacgauuuuaccugcucucaaaucucucccgccgccauagccucaaauugcuacucuucacuuauacuagauuauuuuuccuauccacuuucaaugaaaagugaucuaucagugucuucagcaggccccauuucucaauuuaauuauaaacagaguuucaguaauccuacaugccuaauauuagcaacuguuccucacaauuuaacaacaauaacaaaaccauuaaaauacucauauaucaacaagugcagucgacuucucucagacgacagaacagaacuuccccaacucgucaacgccaaucaauauaguccuuguguuucaauugugccaucaacaguaugggaagauggagauuauuaccgaaaacaauuaucaccccuagaaggagguggaugguuagucgcaaguggaucuaccguagcuaugaccgagcagcuccagauggguuuugguauaaccguacaauauggaaccgauacuaacucaguuugcccaaaacucgaauuugcgaaugacacgaaaauagccagccaacuuggaaauuguguugaguacucacuauacggugucucugguagaggcguauuucaaaauuguaccgcaguaggaguuagacagcaacgauuuguauaugaugcauaccaaaaccuaguaggauacuacucagacgacgguaauuacuauuguuuaagagcauguguaucaguuccaguaucuguaauauacgauaaggaaacgaaaacucacgccacacuauucggcaguguggcaugugaacacaucucaucuacaaugagucaauacucacgaucaacgaggucuaugcuaaaacggcgagauucuaccuacggaccucuucaaacaccuguaggcugcguucuggggcuaguaaauucaucuuuguuuguggaagauuguaaauuaccccucggccaaucucugugcgcucuaccugauacuccaucaacucuuacgccauaa

SEQ ID NO: 2184 - RNA, 2244 nt, Artificial Sequence
  derived and/or modified CDS sequence (opt6) from MERS-CoV__AKN11072__S1
augauacauaguguauuccuauuaauguuccuauuaacuccaaccgaaaguuauguagacguaggaccggacucagugaaaagugccugcauugaaguugauauacaacaaacauucuuugacaaaacauggccgagacccauugacguaagcaaagcagacgguauaauuuauccucaaggcagaacuuauucuaauauuaccauuacauaccaaggauuauuuccuuaucaaggugaucacggagacauguaugucuauucagcgggccaugcaacaggaacaacuccucaaaaacuauuuguagcgaauuauagucaagauguuaaacaauuugcaaacggauuuguaguucgcaucggugcugccgcaaacuccaccgguaccguaaucauaucaccgucaacaagugcaacaauacguaaaauuuacccagcauuuauguuaggaucgucuguuggaaacuucucagauggcaaaaugggacgguucuucaaucauacccucguucuauuaccugacggauguggcacucuacuucgcgcuuucuauugcauccuugaaccuagaaguggcaaccauugcccggccggcaacucauauacaucauucgccacguaucauacgccugcaacagacugcuccgaugggaauuauaaccgcaaugcaucucuaaauucuuuuaaggaauauuuuaacuugagaaauuguacauuuauguacacauauaauauuacugaagacgaaauacuagaaugguucggcauuacccaaacugcccaaggaguacauuuauuuaguuccagauacguagaccucuacgguggaaauauguuccaauuugcaacucuuccugucuaugacaccauaaaauauuauucgauuauuccucauucuauucgaucaauucaaagugauagaaaggcuugggcugcauucuauguauauaaacuucaaccccuaacguuuuuacuggacuucucgguagauggcuauauaagacgagcuauugauugcggauuuaaugauuuaucacaacuacauuguaguuacgaaucauucgauguugagagugguguuuauagugucucuuccuucgaagcaaaacccuccggauccguaguugaacaagcugaagguguugaaugugacuuuucacccuuauuaucuggcacaccaccccaaguauauaauuuuaaacguuuagucuuuacaaauuguaacuauaauuugacuaaauuacuaucacuuuuuagcguaaacgauuucacauguucacaaaucucacccgcagccauagcaucuaacuguuacucaucucuaauucuugauuacuuuucauauccuuuguccaugaaauccgaccucucuguaaguucagcaggaccaauuucucaauuuaauuauaaacaaucuuuuagcaauccaacgugcuuaauauuagcaacaguaccacacaaucuaacgacaauaacaaaaccccugaaauacucauauaucaacaaaugcagcagauuacucagugaugauagaacagaaguaccccaguuaguuaacgccaaucaauauagucccugcguaucuaccguuccuucaacuguaugggaagauggagauuauuacagaaaacaacuuucgccauuggaggguggaggaugguuaguagcauccggaucaacuguagcuaugacagaacaacuacaaaugggcuuuggcauaacaguucaguauggaacagacacaaacucaguaugcccaaaacuagaauuugcaaacgauacaaagauagcaucucaauuaggaaauugcguagaauauucccuauauggcguaagcggacgcggaguauuucaaaauuguaccgcaguaggaguaagacagcaacgauucgucuacgaugcauaucagaauuuagucggcuauuacucagaugacggcaacuauuacugcuuaagagcaugugugucaguaccaguuucugucauauacgauaaagaaaccaaaacacacgcuacacuauucggcucagucgcaugcgaacauauauccucuacaaugagucaauacucacgauccacacgcaguauguuaaagcgaagagacucuacuuacgggccacuccaaacaccaguuggauguguucuaggguuagucaauagcaguuuauucguugaagacuguaaacuaccauuaggucaaucuuuaugcgcauuacccgacacccccucaacacuuacaccuuaa

SEQ ID NO: 2185 - RNA, 2244 nt, Artificial Sequence
  derived and/or modified CDS sequence (opt6) from MERS-CoV__AKN11074__S1
augauccauagcguauuucucuuaauguuucucuuaacaccaacugaaucauacguggauguaggaccugacagcguaaaaucagccugcauugaaguagacauacagcaaacguucuuugacaaaacuuggcccagaccaauagacguaaguaaagcugacggaauuaucuauccccaaggacguacauauuccaacauaacuauaaccuaucagggucuguuuccauaucaaggagaucauggcgacauguacgucuacucagcaggucacgcuaccggcacaaccccucaaaaauuguuuguggccaauuauagucaagacguaaaacaauuugcaaauggauuuguaguacgaauuggagcagcugcuaauucaacuggaacaguaauaauaucaccuuccacauccgcuacaauuagaaaaaucuauccugcuuuuaugcuaggaucgucagucggcaacuucucugacgggaaaaugggacguuucuuuaaccacacucucguccuccuaccugacgguugcggaacauuacuuagagcuuuuuauuguauucucgaaccgagaucugggaaucauuguccagcagguaauucuuauacuagcuuugcuacauaucacacgccagccacggacugcuccgauggaaauuauaaucgaaaugcuucccuuaacaguuuuaaagaauacuuuaaucucagaaacuguacauuuauguauacuuacaauauuaccgaagaugaaauauuagaaugguucggaauuacacaaacagcacaaggaguucaccuauuuaguucuagauaugucgauuuauacggcggaaauauguuucaauucgcaacuuuaccagucuaugauaccauuaaauacuacuccauaauaccucacuccauucgcucaauacaauccgacagaaaagcaugggcagcuuuuuacguauauaaacuucagccacuaaccuuccuuuuggauuuuucaguagauggcuauauccggagggcaauugacuguggcuucaacgauuuaucccaauuacauugcucuuaugaaucauucgauguagaauccggaguauauucagucagcucauuugaagcaaaaccaucuggcucaguaguggaacaagcagaaggagucgaaugcgauuucucaccacuacuaucagguacuccuccccaaguguauaauuucaaacgauuaguauuuacaaauugcaacuauaaucuaaccaaacuacuaucauuauuuagcguaaacgacuuuacguguucucaaauaaguccagcugcuauagcuucuaacugcuacagcucuuuaauucuagauuacuucagcuacccucuaucaaugaaguccgacuuaucaguaucuuccgcagguccuaucagccaauucaauuauaaacaguccuucuccaauccaaccugccuaauacuggcaacaguaccccauaauuuaacaacaauaacaaaaccgcuuaaauauucuuauauuaacaaaugcuccagauuguuaucagaugaccgcacagaaguaccacagcuaguuaaugcaaaccaauacucacccuguguaaguaccguaccauccacuguuugggaagacggagacuauuaccguaaacaacugucaccuuuggaaggaggcggauggcuaguagcaucagguucaacaguagcgaugacagaacaacuucaaaugggauuugguauaacaguacaauacgguacugauaccaacucuguaugcccaaaauuagaguucgcaaaugauacaaaaauagcuagucaauuaggaaauugcguagaauacucucuuuauggcguaucgggcagaggaguauuccaaaauuguacagcaguuggagucaggcagcaacacuuugucuaugaugccuaucaaaaccuuguagguuauuauucugaugacgggaacuauuauugccuaagggccugugucucgguacccgucagugucauauaugauaaagaaacaaaaacacacgcuacucucuuuggaagcgucgcaugcgaacauauaucauccacaaugucacaauauucacguucuacaaggucaaugcuaaaaagacgugacagcacuuauggaccucuacaaacuccagucggauguguacucggcuuaguaaauuccucucuuuuuguggaagacugcaagcuaccucuaggccaaucauuaugugcccucccagauacacccucuacacuaacgccauaa

SEQ ID NO: 2186 - RNA, 2244 nt, Artificial Sequence
  derived and/or modified CDS sequence (opt6) from MERS-CoV__AKN24803__S1
augguacacucaguauuuuuacuuauguuccuauuaaccccuacugaaucauacgucgacguagggccagacucuguaaaaucagcuuguaucgaaguagauauucaacagacauucuucgauaagaccuggccgcgaccgauagauguuagcaaagccgacggcauaauuuauccucagggacguaccuauaguaacauuacaauaacauaccaaggacuguuucccuaucaaggagaccacggagauauguacguauauuccgcugggcacgccacaggcacaacaccccagaaacuauucgucgcuaacuauagucaggacgucaaacaauucgcaaacggcuuuguagucagaauuggagcagcagccaauucgacaggaacuguuauuaucagcccuucuacaucagcuacuauuaggaaaauauauccugcauucaugcuaggaagcucagucggaaacuuuucagaugguaaaaugggacgauuuuucaaucacacauuaguccuauuaccugauggauguggaacacuccugcgcgccuuuuauugcauauuagaaccacgaucgggaaaucauuguccugcuggaaauucuuacaccagcuuugcaacuuaccacacuccggcuacagacugcuccgacgguaauuauaacagaaaugcgucacuaaauagcuucaaagaauauuucaaccuaagaaauugcaccuuuauguauacuuauaauaucacagaagaugaaauucuugaaugguucgguauuacccaaacagcacaaggcguccaucucuucucuucuagauauguagaucuauacggaggaaacauguuucaauuugcuaccuuaccaguuuacgauacuauuaaauauuauucuauaauuccacauuccaucagauccauucaauccgaucggaaggccugggccgccuucuacgucuauaagcuacaaccauuaacauuucuauuagacuuuucuguugauggauauauaagacgcgcaauagauugugguuuuaacgaccuuucucaauuacauugcucauaugaaucauuugauguugaaucuggaguguauuccgugucuucuuucgaagcaaagcccagcggcucuguuguagaacaagcugaagguguugaaugcgacuucaguccuuuauuaagcggaacaccaccccaaguguacaauuucaaaaggcuaguuuuuacgaauuguaauuacaauuucacaaagcuauuaucacuuuucagcgucaaugacuuuacaugcucacaaaucucacccgcugcaauugcgucuaauuguuacuccucuuuaauacuagauuacuuuucauacccgcuuucaaugaaaucagaccuaucagugagcucagcaggaccaauaucccaauuuaacuauaaacaauccuucucaaauccaacgugccuaaucuuagcuacggucccacauaaucuaacuaccaucaccaaaccgcuaaaauacuccuauaucaauaaaugcucccgccucuuaucugaugacagaacugaaguuccccaauuaguaaacgcuaaucaauacaguccaugcgucucaaucguacccuccaccguuugggaagacggagacuauuaucguaaacaacuaucgccacuagaaggaggcggcugguuaguugcuucugguucuacuguugcuaugaccgaacaacuacagaugggcuuugguauaacaguacaguacggaacugauacuaauucagucucuccaaaauuagaauuugcaaacgauacuaaaauagccucacaacuuggaaauuguguugaauauucucuuuacgguguuuccgguagaggaguuuuucaaaauuguaccgcaguagguguccgucaacaacgauuugucuaugaugcuuaucaaaaucuuguggguuauuacucugacgacggaaacuauuauugucuuagagcaugcgucucuguuccaguaucuguuauauaugauaaagaaaccaaaacccaugcaacucuuuucggaucugucgcaugugaacauaucagcucuacuaugucacaauacucacgcagcacaagauccauguugaaacgaagagauuccaccuauggaccacuucaaacaccaguaggauguguucuuggguuagucaauucaucucuauuugucgaagacuguaaacuaccccuuggacaaucccuuugugcguuaccugauacaccaucaacacuaacaccauaa

SEQ ID NO: 2187 - RNA, 2244 nt, Artificial Sequence
  derived and/or modified CDS sequence (opt6) from MERS-CoV__AKN24812__S1
augauacauucaguuuuucuccuaauguuccuacuaaccccaacagaaucuuauguugauguaggaccugacucuguuaaaucugcuugcauagaaguugacauacaacaaacauucuuugacaaaacuuggccgagaccuauugaugucagcaaagcagacgguauuauuuauccacaaggcagaaccuauaguaauauuaccauaacauaccaaggauuauuuccauaucaaggagaccacggugauauguacguauauucugccggucaugccacuggcacaacaccucaaaaauuauucguugccaauuauucacaagacguaaaacaauucgcaaauggauucgucgucagaauaggagcugcagcaaacucaacagguacaguaauaauaaguccuaguacuucagcuacaauaagaaaaaucuauccagccuuuauguuagggucaucaguaggaaauuucuccgacggaaaaaugggacgcuucuuuaaccacacauuaguccuccuuccagacggaugcggaacccuucuucgugcauuuuauuguauacuugaaccacgaucuggaaaucacuguccugccggaaauucuuacacuucuuuugccaccuaucacacaccagcaacggauuguuccgacggcaacuacaaucgaaaugcuaguuuaaauucauucaaagaauacuuuaauuuaagaaauugcacauuuauguacaccuacaacaucacugaagaugaaauucuugagugguuugguaucacacaaacagcacaagguguccaccuauucucgucucguuacguagaccuuuaugguggaaauauguuucaauucgcaacuuugccaguauacgauacaaucaaauacuauuccauuauaccucacagcauacguuccauucaaucagauaggaaagcaugggcagcauucugcguuuacaaacuucaaccccucacauuccuuuuagauuucuccguagacggguauauaagacgagcuauagacugugguuucaacgaucuuucacaacuccauuguucauacgaaaguuucgaugucgaaucgggaguauacuccguaucaucauuugaagcaaaacccucuggaucgguaguugagcaagcggaaggaguagaaugcgauuucucaccacuacuaucuggcaccccuccucaaguauacaauuucaaacgucugguauucacuaacugcaauuauaauuuuaccaaauuacuuucucuguuuagcguaaacgacuucacauguagucagauuucgccagcagcaauugcuucaaauugcuauaguagccuuauacuagacuauuucucauacccccuaaguaugaaaucugacuuauccguaagcucagcaggaccaauaucacaauucaauuacaaacaauccuuuuccaacccaacauguuugauccucgcaacaguuccucacaaccuaacgacaauuaccaaaccucuuaaauauucuuacauuaacaaauguagucgauugcuuucugacgaucgaacagaagugccccagcuagucaacgcaaaucaauacucgcccugugucucuauuguuccaucaaccguaugggaagauggugauuauuauagaaaacaacuuucucccuuagaaggugguggcugguuaguugcaucaggcucgacaguagcaaugacggaacaauuacaaaugggauucgguauaacaguccaauauggaacagauacaaacucugucuguccuaaacuagaauuugcaaaugauacuaaaaucgcaucucagcucgguaauugugucgaauauucucuauaugguguauccggaagaggagucuuccaaaacuguacugccguuggcguaagacagcaaagauuugucuacgaugcauaucaaaacuuaguuggauacuauagcgacgaugguaauuauuauugucucagagcaugcguauccguaccugucucagucaucuacgauaaagaaacuaaaacucaugcuacacuguuuggaucugucgcgugugagcacaucucaucaacuaugucccaguauuccagaucaacacgaucuaugcuuaaaaggagagauuccacuuacggaccccuccaaaccccaguaggauguguccuaggcuuaguaaacucaucacucuuuguggaagacuguaaacuaccacucgggcaaagccuaugugcacuuccagauacucccucuacucuuacaccuuaa

SEQ ID NO: 2188 - RNA, 2244 nt, Artificial Sequence
  derived and/or modified CDS sequence (opt6) from MERS-CoV__AKN24830__S1
augauacacucagucuuucuacuaauguuccuccuaacacccacagaaucuuacguugauguuggaccagauucaguuaaaucugcauguauugaaguugauauucaacaaacauucuuugauaaaacuuggcccagacccauagacguaucaaaagcagauggcauaauauauccacaaggucgaaccuauagcaacaucacaauaacauaccaaggcuuauuucccuaucaaggugaucacggagacauguacguauacuccgcuggccaugccacaggcacaacaccacaaaaacucuucguugcuaauuauucacaagacguaaagcaauucgcaaauggauuuguuguccgcauuggagcugccgccaacucaacaggaaccgugaucauuucaccauccacauccgcaaccauccgcaaaauuuauccugcauucaugcuaggaucaucaguagguaauuuuucagauggaaaaaugggacgauucuuuaaccauacucuaguccuacuaccugauggaugcggcacucuacuuagggcauuuuauuguauuuuagaaccucgaucuggcaaucauugucccgcaggaaacaguuauacaaguuuugcaacuuaucauacacccgccacggauuguucugauggcaacuauaauagaaaugccucucucaauucuuuuaaagaauauuuuaauuuacgaaacuguacauuuauguauacguauaauauaacagaagacgaaauauuagaaugguucggaaucacccaaacugcgcaagguguccaccuauucucaucacgauacguagaucucuacggaggaaacauguuccaauuugcaacccuacccgucuaugauacaauaaaguauuacuccauaauaccucauucaauaagauccauacaaagugaccgaaaagcaugggccgcuuuuuacgucuauaagcuacaaccauuaacauuucuacucgacuuuucaguugauggauauauacgacgcgcaauagauugugguuucaaugauuugucucaacuccauugcucauacgagagcuucgacguagaaucaggaguauauucaguuucgaguuuugaagcaaaaccaucaggaagugucguagaacaagcugaaggaguugaaugcgauuuuucaccacuucuaagcggaacaccaccacaaguauacaacuuuaaacggcucguguucaccaauuguaacuacaacuuuacaaaauuauuaagucuauuuucagugaacgacuucacauguucgcaaauaagucccgcagccauagcauccaauuguuauuccucucucauacucgauuacuuuucauauccccucucaaugaaaucugaucuaagcguauccagugccgguccaauaucacaauuuaauuauaaacaaucuuuuaguaauccaacuugucuaauacuugcaacugucccacauaaccugacaaccauaaccaaaccacuaaaauauucguauaucaauaaauguucucgacuccucucugacgaccguacagaaguaccucaacuuguuaaugccaaccaauauucaccuuguguuucaauaguaccuuccacaguaugggaagauggcgauuacuaucgaaaacaauuaucaccucuagaaggcgguggauggcucgucgccucagggccaacuguagcaaugacagaacaacuucaaauggguuucgguauaacuguucaauauggaacagacaccaacuccguaugcccaaaacuugaauuugccaaugauacaaaaaucgccucacaauuaggcaacugcguagaauauucauuauacggaguauccggaagagguguauuccaaaacugcacugcuguugguguccgacaacaacguuuuguauaugacgcauaccaaaauuuaguaggauacuauucagaugauggaaauuacuauuguuuaagagcaugcgucuccgucccugucagcguuaucuacgauaaggaaacaaaaacucacgcuacucuuuuuggaucagucgccugcgaacauaucucaucaacaaugucacaauauucacgaucaacccggucuaugcuaaaacgacgagauucaacauacggcccucuacaaacgcccguaggcugcguccuuggacugguaaauucuucucuauuuguugaagacuguaaacuaccccuuggccaaaguuuaugcgccuuaccagauacaccuagcacacuaacuccauaa

SEQ ID NO: 2189 - RNA, 2244 nt, Artificial Sequence
  derived and/or modified CDS sequence (opt6) from MERS-CoV__ALB08257__S1
augauacauucaguauuuuuauuaauguuucuccuaacaccaaccgaguccuaugucgauguagguccagacaguguaaagucggcaugcaucgaggucgauauacaacaaacauuuuucgacaaaacauggccacgacccauagauguaucaaaagcugaugggauaaucuauccacaaggccguacauauucaaacauaacaauuacuuaccaaggccuuuucccauaucaaggagaucauggugauauguauguauacucagcugggcaugccacaggcacgacuccccaaaaauuauucguugcaaacuacucacaagaugucaaacaauucgccaacggauuugucguaagaauaggcgcagccgccaacagcaccggaacagucauaauaucccccuccacaagugcuacgauaagaaaaauauauccagcauucauguuagguucaucaguagguaauuucucugauggaaaaaugggcagguuuuucaaccacacuuuaguuuuacuaccagauggauguggaacgcuauugagagcuuucuauuguauucuagaaccacgcucagggaaucacuguccugcaggaaauuccuauacaucguuugcaaccuaucauaccccagcaaccgauuguuccgacggaaauuauaaucguaaugccuccuuaaauaguuucaaagaauauuuuaaucuaaggaacuguacauuuauguauacuuauaauauaacagaagaugaaauacuagaaugguuuggaauaacacaaacagcacaaggaguccaucuuuucuccagccgcuacguagauuuauacggaggaaauauguuccaauucgccacacuaccagucuacgauaccaucaaauauuacucaauaauaccucacucaauaagaucaauucaauccgauaggaaagcaugggccgcauucuacguauacaaauuacagccauuaaccuuccuucuugauuucucaguagauggauacaucagaagggcaauugauugcggcuuuaacgauuuaucacaacuacauuguucuuacgaaaguuucgacguugaauccggcguguauuccguaucaucuuuugaagcuaagccaucagguucugucguagaacaagccgagggaguagaaugugacuucaguccauuacuuucagguacacccccacaaguuuacaauuucaaaagauuaguauuuaccaacugcaauuauaaccucacaaaacuacucuccuuguuuucaguuaaugacuucacauguucacaaauuucaccagcagccauugcauccaauugcuauuccucacuuauauuagacuacuucucauacccucucaguaugaaaucugaccuuucaguaucuuccgcaggaccaauaucccaauucaacuauaaacaauccuuuucgaauccaaccugccuaauucuagcaacuguuccucacaaccucacuaccauuacuaaaccucuaaaauacucauacauuaacaaaugcucaagacuucuaucagacgacagaacagaaguaccacaauuagucaacgcaaaccaauauuccccgugcguaucgauugucccaucuacgguuugggaagacggugacuacuauagaaaacaacuuucaccucuagaaggaggagguuggcuaguugcaagcggcuccacuguagccaugacagaacaacuucagaugggauuugguauuacgguucaauacggaacagacacaaauuccguuugccccaaacuagaguucgccaaugacacaaaaauagcaagucaauuaggaaacuguguagaauauucauuguacggaguaucaggcagaggagucuuucaaaauugcacagcuguagguguaagacaacaacgauuugucuaugacgcuuaccagaaucuuguuggauauuacucugacgauggcaacuacuauugucucagagcauguguuuccguaccuguuagcgucauauaugauaaagaaacaaaaacccacgcuacacuauuuggaucaguagcaugcgaacacauuuccucaacaaugucucaauacucacgcucuacacguucuauguuaaaaagaagagauucaaccuacggaccuuuacaaacucccguaggauguguccuaggccuaguaaauaguucauuauuuguagaagauugcaaauuaccacuaggacaaucucuaugcgcucuaccggacacgccaagcacgcuaacuccauaa

SEQ ID NO: 2190 - RNA, 2244 nt, Artificial Sequence
  derived and/or modified CDS sequence (opt6) from MERS-CoV__ALB08311__S1
augauccacucaguuuucuuacuaauguuccuuuuaacaccuacugaaucauacguagacguaggcccagauucuguuaaaagcgcauguaucgaaguagauauucaacaaacauucuuugacaaaacauggccacguccaauagaugucucaaaagcagauggaauaauauauccccaaggacguacuuauucaaacaucacuauaacauaccaagguuuauucccauaccaaggcgaucauggugauauguacguauacucugcgggauacgcgacuggcacaacaccacaaaaacuauuugucgccaacuacucacaagauguaaaacaauucgcuaauggcuuuguuguacguauuggagcagcagcaaauucaacaggaacaguaaucauuuccccuuccacaagcgcuacaauaaggaaaauauaccccgcauucaugcuagguagcucugucggcaacuuuucagacggcaaaaugggccguuucuuuaaucacacccucguacuacucccagacggcugcggaacacucuugcgcgcauuuuauuguauacuagaacccagaucugguaaucauuguccagcagguaacucguacacuucauuugccacauaccacacuccugcaacagacuguagcgauggaaauuauaaucgaaacgcaucauuaaacucauuuaaagaauacuucaaucuccgaaacuguacuuuuauguauaccuauaauaucacagaagacgaaauacuugaaugguuuggaauuacacaaacagcccagggaguccacuuauuuuccaguagauaugucgacuuauauggaggaaacauguuucaauucgcaacauuacccgucuacgauacuaucaaguacuauaguauuauuccccacucaauaagaaguauucaaagugacagaaaagccugggcugccuuuuauguuuauaaauuacaaccuuugacauuucuucuagauuucucgguagauggauacaucagacgagcuaucgauugugguuuuaaugaucuaucacaauuacacugcucguaugaaucauuugauguugaaucagggguauauucaguaucaucuuuugaagccaaaccuaguggaucgguugucgagcaagcggaagguguugaaugcgacuuuucuccauuacuuucugguacacccccacaaguauauaacuuuaagagacuuguauuuacaaauugcaacuauaacuuaacaaaauuacuuucucuguuuuccguaaaugauuucaccuguucucaaauaucaccagccgccauagcaucaaauugcuauucuucucuuauucuagacuauuuuucauacccuuuauccaugaaauccgaccuuucuguaucaucugcgggaccuaucagccaauuuaauuacaaacaaucguuuucaaaccccacauguuuaauuuuagccacaguaccucauaaccucacaacaauaacaaaaccccucaaauauucauacauaaacaaaugcucacgacuucucagcgauggacgaacagaagucccacaacugguuaaugcuaaucaauauuccccaugcguaucaauuguaccaucaacuguuugggaagacggcgauuacuauagaaaacaacuuagcccauuagaaggaggagguugguugguugcauccggaucuaccgucgcaaugacagaacaauuacaaauggguuuuggaaucacaguacaauauggaacagacacaaauucuguauguccaaaacuagaauuugcuaaugauaccaaaauagcaucccaauuagguaauugcguagaauauucucuauacgguguaucagguaggggaguguuucaaaauuguacagcaguugguguuagacaacagcgauuuguuuaugacgccuaucaaaaucucgucgguuacuauagugaugaugguaauuauuacugcuuaagagcaugugucagcguuccuguaucugucauauacgacaaagaaacgaaaacacacgcaacccuauucggaaguguagcaugugaacauauuucaaguacuaugucucaauacucaagaaguacuagauccauguuaaaaagaagggacagcaccuacggcccucuccaaacgcccguaggaugcguauugggauuaguuaauuccuccuuauucguagaagauugcaaauuaccucuaggucaaagccuuugcgccuuaccagauaccccaaguaccuuaacuccauga

SEQ ID NO: 2191 - RNA, 2244 nt, Artificial Sequence
  derived and/or modified CDS sequence (opt6) from MERS-CoV__ALB08322__S1
augauucacucaguauucuuauuaauguuucuauuaacaccaacugaaucauacguagaugucgguccagacucugucaaauccgcuugcaucgaaguagauauacaacaaacauucuuugauaaaacauggccaagaccaauagacgucuccaaagccgacgguaucauuuacccccaaggacguacuuacuccaauauuaccauuacauaccaaggacuauuuccuuaucaaggagaccacggcgacauguacgucuauucugcuggauacgcuacagguacuacaccacaaaaacucuuuguugccaauuacucacaagaugucaaacaauucgccaauggcuucgucguucgaauaggugccgcugcuaacucaacuggaacuguaaucauuucuccuucaacuucagcaacaauaagaaaaaucuacccugcauucaugcucggaagcagcguggguaacuuuagcgauggaaaaaugggucgauucuuuaaucacacucuuguacuacuaccagaugguugcgguacacuauuaagagcauuuuacuguauacuagagccacgaaguggaaaccauuguccagcaggcaauucauauacaucguuugccaccuaucacacaccagcuacagacuguuccgauggaaauuacaaccgaaaugcuucacuaaauucauuuaaagaauauuucaaucuccgaaauuguacauucauguacacguauaauauaacugaagacgaaauacuagaaugguucggaauaacucagacagcacaaggaguucaucuauucucauccagauaugucgauuuauauggaggaaacauguuccaauuugcuacauuaccuguuuaugauaccauuaaauauuauuccauaauaccgcauucaauacgaucuauacaauccgaccgaaaagccugggccgcuuuuuacguauauaaacuccaaccauuaaccuuccuacucgacuuuucuguggacggauacaucagacgcgcaauagauugcggauuuaacgaccucucacaauuacacugcucuuacgaaucauuugacguugaaucaggcguauauuccguauccuccuucgaagccaaaccuagugguucugucguagaacaagcugaaggggucgaaugcgauuuuucuccccuacugucugguaccccuccucaaguuuacaauuuuaaaagacuuguauuuacaaacugcaauuauaaucuuacaaaacuacuuucacuauuuucuguaaaugacuucacaugcucacaaaucucaccagcugccauagcgagcaauugcuacuccucuuuaauccuugacuauuucucuuaccccuuaucuaugaaaucagaccuaucuguaucauccgcaggaccaauaagccaauuuaauuacaaacaaucauucaguaacccuacuuguuuaauacuugcuacaguaccacauaaccuaaccacuauuacaaaacccuuaaaauauuccuauauaaauaaauguucacgacuauuaagugaugguagaacagaaguaccucaauuaguaaaugcuaaucaauacucacccuguguuucgauaguaccauccacagugugggaagacggcgacuacuaucgaaaacaacuaucuccacuagaagguggaggauggcuaguagcauccggaaguacaguagcaaugacagaacaacuacaaaugggauuuggaauuacaguacaauauggaacugauacaaauucuguaugcccaaaauuagaauuugcaaaugacacaaaaauugcaucacaguuggguaauuguguugaauacucucucuauggaguauccggucgaggcguuuuccaaaauugcacugcaguaggaguacgccaacaaagauucguuuaugaugcauaucaaaauuugguaggcuacuacagcgaugacggaaacuacuauuguuuacgugcaugugucucaguaccuguguccguaauauacgacaaagaaacgaaaacacacgccacucuauucggaucuguagcaugcgaacauauaucuagcacuaugucccaguacuccagaucuacaagaaguaugcuaaaaaggcgggauucgacuuauggcccauuacaaacaccaguaggcugcgucuuagguuuaguaaacucuucacuauuuguagaagauuguaaauuacccuugggacaaucucucugcgcacuaccagauacaccaagcacacucacaccauaa

SEQ ID NO: 2192 - RNA, 2244 nt, Artificial Sequence
  derived and/or modified CDS sequence (opt6) from MERS-CoV__ALD51904__S1
augauacacuccguauuucuuuuaauguuucuucuaaccccuacagaauccuacguugacguagguccagauucaguuaaaucugcaugcauugaaguugacauucaacaaacguucuucgacaaaaccuggcccagaccaauagacguaucaaaagcagauggaauaauauacccucaaggaagaacuuauuccaacauaaccaucaccuaccaaggauuauucccauaccaaggagaucacggcgacauguacguauauucugcgggucaugcaacuggcacaacaccccaaaaacuauuugucgcuaauuauucucaagauguuaaacaauuugcuaacggcuuugucguaagaauuggcgcagcugcuaacuccacaggaacaguaauuauaaguccuuccacaucagcaaccauaagaaaaauuuauccagcauuuaugcucgggucaucuguagguaacuuuucagauggaaaaaugggaagauucuuuaaccauacauugguccuuuuacccgauggguguggcacauuacuacgugccuuuuauuguauccuagaaccuagauccggcaaucauugcccagcuggcaauuccuauacuucauuugcuaccuaccacaccccugccaccgacuguuccgauggaaauuacaauagaaaugcuucauuaaacaguuuuaaagaauauuuuaaucuccguaauugcacauuuauguauacguauaauauaaccgaagaugaaauucuggaaugguuugguaucacucaaacagcacaagggguucauuuauucucuucaagauacguugaucuauacggaggaaacauguuucaauuugcaaccuuaccugucuaugauacuauuaaauauuauuccauaauaccacacucaauucgaaguauacaaucugaucgaaaggcuugggcagccuuuuauguauauaaacuacaaccucuuacuuuucuacucgacuuuagcguugaugguuauauccgcagagcaauugacuguggcuucaacgaucuaagucaacuacauuguucuuaugaaucauuugacguugaaucagguguauauucuguuucaucuuuugaggcaaaaccauccgguaguguuguagaacaagcagaaggcgucgagugugauuucucuccauuguuaucagguacaccuccucaaguauauaacuuuaaaagacugguauuuacuaacugcaauuauaauuuaacaaaacuacucucauuauucucaguaaaugauuuuacauguucucaaauaaguccugcggcaauugcuucaaacuguuauucaagucucauuuuagacuauuucucauaucccuuaucaaugaaaucugaccucaguguaagcagugccggaccaauaucccaauucaacuauaaacaaucauuuucaaacccuacaugccucauccuagcgacaguaccacacaacuuaaccacuauuacgaaaccacuuaaauauagcuacaucaauaaaugcucccguuuacuaucugaugaccgcacggaagucccacaacuuguaaacgcuaaccaauauucuccauguguuagcauuguacccagcacaguuugggaagauggagauuacuauagaaaacaacuuucccccuuagaaggcgggggcugguuaguugcauccggcuccacagucgcgaugacagaacaguuacaaaugggcuuuggaauaacuguacaauaugguacagauaccaacuccgucugcccuaaacucgaguuugcuaaugauacuaaaauugcaagucaauuaggcaauugcguagaauauucgcuuuacggaguaucaggacguggaguuuuucaaaauugcacagcugucggaguacgacaacaacgcuucgucuaugaugcauaccaaaacuuaguuggcuauuauagcgaugauggaaauuauuacugucuacgcgcaugcgucucaguaccaguaucugucauuuaugacaaagaaacgaaaacacaugccacccuauucgggucuguugcaugugaacacaucuccuccacuaugagccaauacucucgaucuacuagaagcauguuaaaaagaagagauucgacauauggaccuuuacagacuccuguagguugcguauuagguuuagucaacucaucucuuuuuguagaagauugcaagcucccauuaggacaaagucuuugcgcacuucccgauaccccaaguacacucacacccuaa

SEQ ID NO: 2193 - RNA, 2244 nt, Artificial Sequence
  derived and/or modified CDS sequence (opt6) from MERS-CoV__ALJ54446__S1
augauacauucgguauuccuuuuaauguuucuccuuacaccaacugagucauauguugacguugggccggacucaguaaagagcgcaugcauagaaguagauauacagcaaaccuucuucgacaaaacuuggccacgaccuauagaugucucgaaagccgauggcauaauuuauccccaaggccgaacauauucuaauauaacaauaacuuaucaaggacuauuuccauaucaaggugaccacggugacauguauguauacuccgcuggccacgcaacuggaacaacaccacaaaaacucuuuguagcuaacuauucucaagaugucaaacaauucgcaaauggauucguagugaggauaggagcagcagcuaauuccacaggcacaguaauaauaucaccuuccaccucagcaacaaucagaaaaaucuaucccgcuuuuauguuagguucuucaguaggaaacuuuucggauggaaaaaugggaagauucuuuaaccauacauuaguauuauugccagacggcugugggacacuuuuacgagcauuuuacugcauccuugagccaagaucaggaaaucacugcccagcagguaacuuuuauacuuccuuugcgaccuaucauaccccggccacugauugcagugacggaaauuauaaucgaaacgcaucacuuaacuccuucaaagaauauuuuaaucuuagaaacuguacuuuuauguacacauacaauauaacugaagacgaaauacuggaaugguuuggaauaacucaaacugcacaagguguccaccuauuuucuucacguuaugucgaucuauacggaggaaacauguuccaauuugcaacauugccuguguacgauacuaucaaauauuauuccauaauaccccacucuauacggucaauccaaucagacagaaaagcaugggcugccuuuuauguuuauaagcuacaaccacucacauuccuccuugacuuuagcgucgauggauacauaagacgagcgauagauugugguuuuaaugacuuaagccaacuacauuguucauaugaaucauucgacguugaauccgguguauauagcguauccucauuugaagcaaaaccuuccggaucgguuguagaacaagcagaaggcgucgaaugugauuucucaccauuacuuucaggaacacccccacaaguauauaacuuuaaaagacucguauucaccaauuguaacuacaaccuuacaaaacugcucucuuuauucucuguaaacgauuuuaucugcucgcaaaucaguccagccgcaauagcgucaaacugcuauaguucacuaauucucgauuauuuuucuuauccucuaucaaugaaaucagaccucuccguauccucagcaggucccaucucucaauucaauuauaaacaaucuuucuccaauccaacaugucuuauauuagcaacagucccacacaaucuuaccacuauuacgaagcccuuaaaguauucauauauaaauaaguguucacgucuucucucagaugacagaacugaaguuccacagcuaguaaacgcaaaccaauauucaccuuguguuucuauaguuccauccacuguuugggaagacggcgauuacuacaggaagcaacucaguccuuuagaaggaggcggcuggcuagucgcauccggcuccacuguagcaaugacagaacaacuucaaaugggguucggaaucacgguacaauauggaacagauacaaauuccguaugccccaaacuugaauuugcaaacgacacaaaaaucgcaucucaauuagguaauuguguagaauauagccuauacgggguauccgguagagguguauuccaaaauugcaccgccgucggaguaagacaacaacguuucguauacgacgcguaccaaaaccuaguuggauacuauucugaugauggaaacuacuauugucucagagcauguguaucaguaccagucucaguaaucuacgauaaagaaacuaaaacacaugccacucuguucggaucuguagccugcgaacacaucucaucgaccaugucccaauauucuagaucaacucgauccauguuaaaaagaagggauucuaccuacggcccccugcaaacaccaguaggauguguuuuaggucuaguaaauucuaguuuauuugucgaagauugcaaauuaccacucggacagucucuaugugcucugccugauacuccuucaacacuuacacccuaa

SEQ ID NO: 2194 - RNA, 2244 nt, Artificial Sequence
  derived and/or modified CDS sequence (opt6) from MERS-CoV__ALJ54448__S1
augauucacuccguauuccuacuaauguuucuauugacgccuacagaaagcuauguagacguagguccagacucaguaaaaucagcguguaucgaagucgacauucaacagacuuucuuugauaagacuuggccacgaccaauagacguaucuaaagcugacggcauaauauacccgcaagguagaaccuacucaaacauaacaauaacuuaucaaggacuauuucccuaucaaggagaccacggugacauguacguauauagugccggccaugcaacugguacaacaccacaaaaauuauuuguagcaaacuauucacaagaugucaaacaguuugcaaauggauuuguaguccguaucggagcugcugcaaacuccaccgguacaguuauaauaagucccucuacaagcgcaacgauucgaaaaauauauccagcuuuuaugcuagguagcucagucgguaacuuuagugacggaaaaaugggccguuucuuuaaucacaccuugguucucuuacccgacggauguggcacucuacuaagagcauuuuacuguauauuagaaccacguucaggaaaucauuguccugccgguaauucauacacuuccuuugccaccuaucauacaccagcuacagacuguagcgaugguaacuacaaucguaacgcuauucuaaauucauuuaaagaauauuuuaaucucagaaauuguacuuuuauguacacauacaauaucacugaagaugaaauccuggaaugguuuggcauaacccagaccgcacaaggaguucacuuauuuucuucacgcuaugucgaccuauauggagggaacauguuucaauuugcaacacuaccagucuaugauaccauaaaguacuauucuaucaucccacauaguauacguucuauacaguccgacagaaaagccugggcagcauucuaugucuacaaauuacaaccacuaacuuuucuucuagacuuuucuguagauggcuauauacgcagagccauagacugcggauucaaugaccuuucacaacuacauuguucauaugaaucauucgacgucgagagcggaguauauuccguaucuagcuuugaagccaaaccaagcggaaguguuguagaacaagcugagggcguugagugugacuucucuccucuacuaucagguacuccaccacaaguauauaauuuuaaacgauuagucuuuacaaauuguaacuauaaccucacaaaacuccuaucacuuuuuaguguaaaugauuucacaugcucucaaauauccccugcagcaauagcuagcaauuguuauaguucucucauacuagauuacuuuucauacccacucucuaugaaaucagauuuaucaguuucaucagcaggcccaauuucacaauucaauuacaaacaaucauuuucaaacccgacaugcuuaaucuuagcaacagugccucauaauuuaacaacuauuaccaaaccacucaaauauucauauaucaacaaauguucgcgauugcucucggaugauagaacugaaguaccucaauuagugaaugcaaaccaauacagucccuguguaucaauaguaccaucaacagucugggaagacggagauuauuaucgaaaacaacuaaguccuuuagaaggcggcggaugguuaguugcaucuggaucuaccguggcgaugacagaacagcuacaaauggguuuugguauaaccguucaauacggaaccgauacaaauucuguuugcccuaaacuugaguucgcaaacgacacaaaaaucgcuucgcaacugggaaauuguguugaauacucacuauauggagugaguggcagaggaguauuucaaaauuguaccgccguuggaguacgccaacaacgcuuuguuuacgaugcuuaucaaaacuuaguuggauacuauagugaugauggaaacuauuauugucuacgagcaugugucucuguaccuguaucaguuaucuaugauaaagaaacaaaaacccacgccacuuuauuuggaagcguugcuugcgaacauaucucaucaacaaugucccaguacucuagaagcacacgcucaaugcuuaaacgaagagauucaaccuacggaccacuacaaacaccaguaggcuguguccugggacucguaaacuccagccuuuucguagaagauuguaaacuuccacuuggucaaucacucugugcucuaccugacacacccagcacacuaacaccauaa

SEQ ID NO: 2195 - RNA, 2244 nt, Artificial Sequence
  derived and/or modified CDS sequence (opt6) from MERS-CoV__ALJ54450__S1
augauacauucugucuuucuacugauguuccuauuaacaccuacugaaucguauguggauguuggaccagauucaguaaaaagugcaugcauugaaguugacauccaacaaacauuuuucgacaaaacuuggccuaggccaauagauguaucaaaagccgauggaaucaucuauccacaaggccgaaccuauucaaacauaacuaucacauaucaaggccuauucccauaccaaggagaccauggcgacauguacguguauucagcaggccacgcaaccgguacaacaccccaaaaguuauucguggcaaacuacucucaagauguaaaacaguucgcaaauggauuuguaguuaggauuggagcagcugcaaacucaaccggcacuguaauaauaucuccaaguaccuccgccacaauccguaaaauuuacccagcauuuaugcuuggaucaucaguuggaaacuuuucugauggcaaaauggggagauucuuuaaucacacccuaguucuauuaccagauggaugcggcacacuauuaagagccuucuauugcauacucgaaccucgaucgggaaaucacugcccagcuggcaacuccuauacaucuuuugcaacuuaccauaccccugcaacagacuguucugaugguaacuacaaucgauaugcuucuuuaaauucuuuuaaagaauauuucaauuuacguaauuguacauuuauguauacauauaacauaacggaagacgaaauuuuagaaugguuuggaauaacccaaacagcccaaggaguucaucuauuuucaucuagauacgucgacuuauauggagguaauauguuccaauucgcaacacuaccaguauaugauaccauaaaauacuauucaauaauaccccauaguauucgaucaauccaaagugaucgaaaagcaugggcugcuuucuauguuuauaaacuacaaccgcuuacauuccuauuagauuuuuccguagauggcuauauacgucgcgcaauagacuguggauucaacgaccucucucaacuacauugcucauaugaaucauuugauguagaaucuggagucuacucggucucauccuucgaagcaaaacccuccgggucaguaguagaacaagcagaaggcguugaaugugauuuuagcccacuauuaucagguacaccgccacaagucuauaauuuuaaacgccuaguauucacaaauuguaacuacaacuuaaccaaguuauuaucccucuucucggucaacgacuucacaugcucccaaaucucuccagcugcuauagcuucuaacuguuauucaucccucauacucgauuauuuuucauauccacuuucaaugaaaagugaucucagcguuagcuccgcaggaccaauuucucaauucaauuacaagcaaucauucucuaauccgacaugcuuaauacuagccacgguaccacauaaucucaccacgauaacaaaaccacuaaaguauucguauauaaacaaauguaguagacucuuaagcgacgaucgcacagaaguaccccaacucguaaacgcaaaucaauacucccccugcgucucaauaguaccaagcacuguaugggaagauggagauuauuaucgaaaacaauuaucuccccuagaaggugguggauggcuuguagccucagggucuacaguagccaugacugaacaauuacaaaugggauuuggaaucacaguacaauacggcacagauacaaauucggucuguccaaaauuagaauuugcuaaugauacaaaaauagcuucgcaacuaggaaacugugucgaauacagccuauauggagucuccggcagaggcgucuuccaaaacuguacugcagucgguguucgucaacaacguuucguauaugacgccuaccaaaaucuaguuggauacuacuccgacgaugguaauuacuacugccuacgggcauguguuucuguaccaguauccguuauauaugauaaagaaacaaaaacacacgcuacccucuucggaaguguagccugugaacauaucucaaguaccaugagccaauacucaagguccacaagauccaugcugaaacguagggacaguacauacgguccccuacaaaccccaguugguugcguacuaggucuaguaaacuccucuuuauucguugaagauuguaaacucccacuaggucaaagccuuugcgccuuaccagauacuccauccacacuaaccccauaa

SEQ ID NO: 2196 - RNA, 2244 nt, Artificial Sequence
  derived and/or modified CDS sequence (opt6) from MERS-CoV__ALJ54453__S1
augauccauucuguauucuuacuaauguuucuccucacaccaacagaaucauacgucgacguuggaccagacucuguaaaaucagcuuguauagaaguugauauacaacaaacauucuucgauaaaaccuggccuagaccaauagauguuuccaaagcggacgguauuauauauccacaagggagaacuuacuccaauauuacaauaacauaucaaggucuauucccauaucagggcgaccauggugauauguauguauauagugcaggccacgcaacuggaacaacaccccaaaaacuauuugucgcuaauuauucacaagauguaaagcaauuugcuaacggcuucgucguucgcaucggagccgcagcuaauucaacagggacgguuauaaucaguccuuccaccucagcaaccauccggaaaaucuauccagcauuuaugcuaggaucauccguuggaaauuuuucagaugggaaaauggguagauuuuucaaucauacacugguccuacuacccgacggaugcgguacacuucuaagagcauuuuauuguauacuagaaccuagaagcggaaauuauugcccagcagggaacucauacaccucauuugcaacauaccacacacccgccacugacugcucugacggaaacuauaaucgaaaugcuucacuaaacucuuucaaagaauauuuuaaccuuagaaacuguacauuuauguauacauauaauauaacagaagacgaaauucuugaaugguucgggauuacccaaaccgcucaaggaguacaucuauucucgaguagguacgucgaucuauaugguggaaacauguuucaauucgcaacccuuccugucuaugauacaauaaaauacuacuccauaauaccccauaguaucagaucuauacaaucagauagaaaggcuugggcagcuuucuauguauauaaauuacaaccacuaaccuucuuacuagacuuuucaguagauggauacauacgacgcgcaauagauugugguuucaaugaccucucccaauuacauugcaguuaugagagcuuugacguagaauccggcguuuauagcgucagcucuuuugaagcaaaacccucagguucaguagucgaacaagcugaaggcguagaaugugacuucucaccacuccuaucagguacacccccucaaguauauaacuucaaaagauuagucuuuacuaauuguaauuauaauuuaacaaaacuucuaucuuuauuuuccguuaaugauuuuaccugcucucaaauuucaccagcagccauugcaaguaacuguuauucuagccucauacuagacuauuuuuccuauccacucucaaugaaaucagacuuaucuguaucaagugcggguccuauuucccaguuuaacuauaaacaaucauucuccaacccgaccugucucauacuagcuacaguaccccauaacuuaacuacgauaacgaaaccacuaaaauacucuuauauuaauaaaugcagucgacucuuaucugaugauagaacagaaguuccacaacucguaaaugcaaaccaauacaguccauguguuucuauaguaccauccacaguaugggaagauggagauuacuaccgaaaacaacuaucaccguuagagggcggagguugguuaguugcaucuggauccacaguagcaaugacggagcaacuucaaaugggcuuuggaauaaccguccaauacgguacggauacaaacagcguuugccccaaauuagaguucgcuaaugacacaaaaaucgcuucucaacuaggcaacugcguagaauacagcuuauauggcguaucuggcagaggcguuuuccaaaacuguacugcugucggcguaagacaacaacguuucguauacgacgcauaccaaaaccuugucggcuacuauagcgaugauggaaacuacuacugccugcgagccuguguuucaguucccguaaguguuauauaugauaaagaaacuaaaacacacgcaaccuuguuuggaucgguagcaugugaacacauaucaucaacaaugucacaauacucacgaucaacacggucaaugcuaaaacgucgagauucuaccuauggcccucuucaaacaccaguuggaugcguauuaggucuaguuaauucaucacucuucguagaagauugcaaacuuccauuaggccaaaguuuaugugccuuaccagacacaccaagcacacucacgcccuga

SEQ ID NO: 2197 - RNA, 2244 nt, Artificial Sequence
  derived and/or modified CDS sequence (opt6) from MERS-CoV__ALJ54455__S1
augauacacucaguauuucucuuaauguuucuauuaacaccaacagagagcuacguagacguaggucccgauucaguaaaauccgccuguauagcuguagauauacaacaaacauucuucgacaaaacuuggccaagaccaauugauguaucaaaagccgacgggauuauuuauccccaaggacgaacauacucaaauaucacaauaacauaucaaggucucuucccuuaucagggagaucacggagacauguacgucuauucagcaggacacgcaacagguacuacaccacagaaacuuuucguugcaaauuacucucaagaugucaaacaauucgcuaauggguucguaguaagaauaggagcggcugcgaacucaacuggaaccguaauuauaucaccaagcacaucggcuacaauccgcaaaauuuauccagccuucaugcucgguucaucgguaggcaauuuuuccgauggaaaaauggguagauuuuucaaucauacccuugucuuacuuccagauggcugcgggacacuauuacgcgcauuuuauugcauauuagaaccucgaagcggaaaucauuguccugcaggaaacucauacacaucauuugccacauaccacacuccagcaacugacuguucagauggaaauuacaaucgcaaugcuucauuaaauuccuucaaagaauacuuuaaucuacguaacuguacuuuuauguacacauauaauaucacagaggaugaaauauuagaaugguucggcauaacucagaccgcucaaggaguucaucuauucucaucacguuaugucgaucuauauggaggaaauauguuucaauucgcaaccuuaccuguauaugacacaauuaaauauuauucaauaaucccccauuccauaaggucaauucaauccgaccguaaagcaugggcagcauuuuacgucuacaaauuacaaccucucacauuuuuauuagacuucagugucgauggcuacauacgcagagcuauugauuguggauucaaugacuuaagucaacuacacuguucuuacgaaucuuuugacguagaaagugguguauacagugucucuaguuuugaagcgaaaccuucgggcucugucgucgaacaagcugaaggaguugagugcgacuucagcccucuacuaucaggaacaccaccacaaguuuacaauuucaaacguuuagucuucacaaacuguaauuauaaucuaacaaaauuacucucacuauuuucaguaaaugacuucacuuguucccaaauuuccccggcugcuauagcaucuaauugcuacucuucgcuaauucuagauuauuucucuuauccacuuuccaugaaauccgauuugagugugucaucagccgguccaauaucucaauuuaacuauaagcagagcuuuuccaaucccacaugccuuauacuagcgacaguuccucauaaccucacuacuauaacuaaaccacuaaaauauucguacauaaacaaguguagccgacuauuguccgacgauaggacagaagugccccaacucgucaacgcaaaucaauacucuccguguguaagcauaguaccuucaacaguuugggaagauggugauuauuauagaaaacaacuaucuccacucgagggcggaggaugguuaguggcuaguggaaguacuguugcgaugacagaacaauuacaaaugggguuuggaaucacuguacaauauggaaccgacacaaacucagucugccccaaguuagaguuugcuaaugauaccaaaauagccucacaacuaggaaauugcguugaauacucacuauauggaguaucagguagaggcguauuucaaaacuguacugccguagguguacgacagcaacgguucguauaugacgcauaucaaaaccuaguuggcuauuauucagaugauggcaauuacuacugucuaagagcauguguaagcguaccaguaucaguaauuuaugauaaagaaacaaaaacacacgccacacuauucggaucaguagcaugcgaacauauuagcucaacuaugucccaauauagucgaucaacuagauccaaacuuaaacggcgcgacagcacauaugggccucuucaaacuccaguaggcuguguacuaggauuagucaauucaucacucuuuguagaagacuguaaauugcccuugggacaaucucuaugugcacuccccgauaccccaagcacacuaaaaccauga

SEQ ID NO: 2198 - RNA, 2244 nt, Artificial Sequence
  derived and/or modified CDS sequence (opt6) from MERS-CoV__ALJ54456__S1
augauacacucugucuuuuuacuaauguucuuacucacuccaacugagucuuacguagauguaggaccagacuccguaaaaucagcaugcauagcuguagauauacaacaaaccuucuuugacaagacuuggccacgucccauugacguuucaaaagccgaugguauaauuuauccucaagguagaaccuacucaaauauaaccauuacauaucaaggacucuucccauaucaaggagaccauggugauauguacguuuauagcgcuggucaugcaaccggaacuacuccucaaaaacuuuuuguugcaaauuauucacaagaugugaaacaauuugccaaugguuuugugguaagaauaggagccgccgcaaauagcacaggcacuguaauuauuuccccaaguaccagugcuaccauaagaaaaauauacccugcuuuuaugcuaggaagcucagucggaaauuuuucugauggaaaaaugggcagauucuuuaaccacacacuuguucuacuuccagacggcugugguacacuacuacgagcauuuuacugcauccuugaacccagaaguggcaaucauugcccagcuggaaacuccuauacuucuuuugcaacauaccacaccccagcuaccgauuguucugacgguaauuauaaccgaaacgcaucucuaaacucuuucaaagaauauuuuaaccuccgaaacugcaccuuuauguacacuuauaacauaacagaagacgaaauacuagaaugguucggcauaacacaaacagcacaagguguccaucuauuuucuagccgcuauguugaccucuacggagguaauauguuucaauucgccacauuaccuguuuacgauacaauuaaauauuauucuauuauaccacauucuauaaggagcauucaguccgaccgcaaagcaugggcugcauucuacguauauaaauuacaaccauuaacauuuuuacuugauuucucuguagauggauacaucagacgcgccauagauugcggcuuuaaugauuugagccaauuacacuguucuuacgaaucauucgacgucgaaucgggaguguauuccguuucaucuuucgaagcaaagccaucggguucaguuguagaacaagcugaagguguugaaugcgauuuuuccccacugcuuucagguacacccccacaaguauauaauuuuaagaggcuaguauucacaaauuguaauuacaauuuaacuaaacuacuaucgcucuuuucuguaaaugauuuuacauguucacaaauauccccagcugcaauagccaguaauugcuacucaucuuuaauauuagauuacuuuucuuacccacucuccaugaaaucggaccuuuccguaucaagugcuggucccauuucccaauucaauuauaaacaaucauuuucaaauccaaccugucuaauucuugcaacagucccucacaacuuaacuacaauuacaaaaccacuuaaauacuccuauauaaacaaauguucucgcuuacucucagacgaucgaaccgaaguuccgcaauuaguuaaugcaaaccaauacucccccugcguaaguaucgucccaucuacuguuugggaagauggugacuauuauagaaaacaacucucaccacuagaaggcggagguuggcucguggcaaguggauccacuguugccaugacagaacaacuacaaaugggauuugguauuacaguccaauacgguacggacacuaacagcguaugcccuaaacuugaauuugcuaacgauacaaaaaucgcaucucagcuuggcaauuguguagaauauagucuuuauggaguuucgggccgaggagucuuucagaauuguaccgcaguaggugucagacaacaacgauuuguuuacgaugcuuaucaaaaucuagucggauacuauucagaugauggaaacuacuacuguuuaagagcaugcgucucugucccaguaucaguaaucuaugauaaagaaacaaaaacccacgcaacucucuuuggaucugucgcuugugaacauauaucuucaacuaugucacaguauuccagaucuacucgauccaugcuaaaacgaagagauucaacauauggaccucuacaaacucccguuggaugcguucucggccuagucaacucaagucuauuugucgaagauuguaaacucccacuaggacagagcuuaugcgcacuaccugacacaccuuccacacuaaaaccauaa

SEQ ID NO: 2199 - RNA, 2244 nt, Artificial Sequence
  derived and/or modified CDS sequence (opt6) from MERS-CoV__ALJ54461__S1
augauucacucaguuuuucuauuaauguuuuuauuaacuccaacagaaucauacgucgacguaggacccgauuccguaaaaccagcauguauugaaguagacauucaacaaacauucuuugauaaaacauggccaagaccaauagauguaucaaaagccgauggaauuaucuauccccaaggucgaaccuacucaaacauaacuaucacauaucaaggcuuauuuccauaccaaggagaucauggugauauguacgucuacucugcaggacacgccacgggaacuacaccacaaaaacuauuuguagccaauuacucucaagauguaaaacaauuugcaaacggauuuguuguaagaaucggcgccgccgcuaacucuacugguacaguaauaauaucaccaucuaccucagcuaccaucaggaaaauauauccugcuuuuaugcuuggaucuuccguaggcaacuuuucugaugguaaaaugggacguuucuuuaaccauacucuaguacuauugcccgauggcuguggaaccuuacuaagagccuuuuauugcauccuugaaccuagaaguggaaaccacugcccagcaggcaauuccuacacauccuuugcuacauaucacacaccagcaacagauuguucugacggcaauuacaauagaaaugcauccuuaaacucuuuuaaggaauauuuuaaccuucguaacugcacauucauguacacauauaacauaaccgaagacgaaauacucgaaugguuuggaauaacucaaacagcacaaggagugcaucuauuuuccucacgcuacgucgauuuguacggagguaauauguuucaauucgcgacucuacccguuuacgauacaauaaaauacuacuccaucauaccacauucuauuagaucaauacaaagcgacagaaaagccugggcagcuuuuuacguauauaaacuacaaccccuuacauucuuacucgauuuuucaguugauggauauaucagacgagcaauagacuguggauuuaaugacuugucucaacuccauugcucauacgaaucauuugauguagaaucaggcgucuauucagucucuucuuuugaagcaaaaccaucaggaucagucguugaacaagcggaaggaguagaaugugauuuuucaccuuuauuaaguggaacaccaccacaaguauacaauuuuaaacggcuaguauucacuaauuguaauuauaaucuuacaaaacucuuaucauuauucuccgucaaugauuuuacuugcucccaaauaucgccugcagccauagcuuccaacuguuauuccucccuaauacuggauuauuuuagcuauccacucucaaugaaauccgaccucucaguaacaagcgccggucccauaucccaauucaauuacaaacagagcuuuaguaauccaaccuguuuaauuuuagcuacuguuccucauaaucuaacaacuauuacaaaaccuuuaaaauauucuuauaucaauaaaugcagccgauuauugucagacgacaggaccgaaguuccacaacucguaaacgcaaaucaauauucaccaugcguuaguauaguuccgaguacaguuugggaagacggcgauuauuaucgcaaacaauuaucaccucuugaagguggaggauggcuagucgcaucugguaguaccguagcuaugacagaacaacuacaaauggguuucggaauaacaguccaauacgguaccgacacuaauuccguaugcccaaaacucgaguucgcaaaugacacgaaaauagcuucacaacuuggcaauugugucgaauauucucuauauggaguaucaggaagaggcgucuuucaaaacugcacagcagucggcguacgacaacaaagauuuguguaugaugcuuaccaaaaccuuguaggcuacuacucagaugacggcaauuacuauugccuucgagcaugugucucgguuccugucaguguaauauaugacaaagaaacuaaaacccaugcaacccucuucggaucuguagcaugugaacauauuaguuccacgaugucccaauacucaagaucaacacgcuccaugcuuaaacgacgggauucaacauacggcccccugcaaaccucuguaggauguguuuugggucucguaaauuccucacuuuucgucgaagacuguaaauuaccauuaggacaauccuuaugugcgcugccggacacacccucaacauuaacaccauaa

SEQ ID NO: 2200 - RNA, 2244 nt, Artificial Sequence
  derived and/or modified CDS sequence (opt6) from MERS-CoV__ALJ54468__S1
augauccacucaguuuucuuacuaauguuucuuuuaacccccaccgaaucauacguggacguaggcccugauucuguaaaauccgcauguauagaaguagauauccaacagacguucuuugauaaaacauggccccgaccuauagacguuucaaaggccgauggaauaauauacccacaaggaaggacauauuccaauauaaccauaaccuaccaaggucuauuuccauaucagggcgaucacggugacauguacguauacucugccggacacgcaaccgguacuacaccacaaaaauuguuuguagcaaauuauagucaagauguuaaacaauucgcgaacgguuucgucguuagaauaggagcagcugcaaauucaacgggaacuguaaucauaucuccaucaacuucugcgacuauacgaaagauauacccagccuucauguuagguucaucaguaggcaacuucucugauggaaaaaugggacgcuuuuucaaucacacacuugugcugcucccugacggcugcggcacacuacuccgcgcauuuuacuguauacuugaacccagaucagguaaucauugccccgcaggaaauucuuauacaucuuuugcaacuuaccauacuccugcaaccgauugcagcgauggaaauuauaaucguaacgcaucauuaaacaguuuuaaagaauauuucaauuuaagaaacuguaccuucauguacacauacaauauaacagaagacgaaauucucgaaugguuuggaauaacacaaacugcucaaggaguacaccucuuuuccucucguuacguggaucuauauggcggaaacauguuucaauucgccacucucccaguuuaugauacaauaaaauacuauucaauaauaccccauucaaucagaaguauucaaucagaucguaaagcaugggcagccuucuacguauacaaacuacaaccauuaacauucuuauuagacuucucaguagacggauacauaagacgugcaaucgacugcgguuucaaugaucuuucacaauuacauugcuccuacgaaucauucgacguugaaucagguguauauaguguaucaucauuugaggcgaaacccucugggagcguagucgaacaagcagaagggguagaaugugauuucucaccacuauuaucaggaacaccuccucaaguuuacaauuucaaacgauuagucuucacuaauugcaauuauaauuuaacaaaauuauuauccuuauucuccguaaaugacuuuauaugcucccaaaucucuccagcugcaauagccucaaacuguuauaguucauuaauucucgacuacuuuucauacccucugagcaugaaaucagaucuuucaguuaguagcgcgggccccauaucacaauuuaauuacaaacagagcuucucaaauccgaccuguuugauccuagccacuguuccucauaaucuaacaacaaucacuaaaccucucaaauacuccuacauuaacaaauguuccaggcuacuuucagaugaccgaacugaaguaccacaacugguaaacgcaaaccaauacucaccaugcguaucaauuguaccaucaaccguuugggaggauggugacuauuaccguaaacaacuuucaccuuuagaggguggcggauggcuaguagcauccggaucaacaguugccaugacagaacaacuccaaaugggauuuggaauaacaguacaauauggcaccgauacuaauuccguaugcccaaaauuggaauuugcaaacgacacaaaaauagcuucacaacuuggaaauugcgucgaauauucacuuuacgguguaucuggacgagguguauuucaaaauugcaccgcagucggugugcgacaacaaagauuuguauacgaugccuaucaaaaccugguagguuauuauucagaugacggaaacuauuacugucucagagcaugcguuucggucccugucucaguuauauacgacaaagaaaccaaaacucaugcuacccuauucggaucuguagccugugaacauauuucauccacgaugucccaguacucucgcucuacaagaucuaugcucaaacguagagauucuacuuauggacccuuacaaacuccaguuggaugugucuuaggucucgugaacagcagucuauucguagaagacugcaaacuaccacuuggccaaagccuuugcgcauuaccagauacaccuuccacgcucacaccauaa

SEQ ID NO: 2201 - RNA, 2244 nt, Artificial Sequence
  derived and/or modified CDS sequence (opt6) from MERS-CoV__ALJ54471__S1
augauacauucuguauaucuacuaauguuccuuuuaacaccaaccgaauccuauguagaugucggccccgacucaguaaaaagcgcgugcauagaaguagauauacaacaaacuuucuuugauaaaacuuggccaaggccuaucgacguaaguaaagcagaugguaucauauauccacaaggacgaacuuauucaaauauaacgauaaccuaucagggccuauucccauaccaaggugaucauggagauauguauguuuauucagcgggacacgcuacuggcacuaccccucaaaaacuuuucgucgcaaauuauucccaagaugugaaacaauucgcuaacggauuuguuguucgaauaggugcugcugcaaacuccaccggaacaguaauuauauccccaagcacuucagcuaccauaagaaagauauacccugcauuuaugcuagguucaucaguugguaauuucagcgauggaaaaaugggaagauucuuuaaucacacucuuguccuucucccagauggauguggaacucuccuaagagccuuuuauuguauacucgaaccaagaaguggaaaucauugcccagcaggaaauucguacacaucuuucgcaacuuaccacacuccugcuacagauuguucugauggaaauuauaaccgaaaugcaucccuuaacucauuuaaagaauauuucaauuuaaggaauuguacauucauguacacguauaacauaacagaagacgaaauucuagaaugguucggcauuacucaaacugcacaaggaguacauuuauuuucaagcagauauguagaucuauaugguggaaacauguuccaauucgccaccuuaccagucuacgauacaauaaaauauuacuccauuauaccacacagcauaagaucaauucaaucugaccgaaaagccugggcugcauuuuacgucuauaaacuacaaccacuaacuuuccucuuggauuucucgguugacggauauauaagacgagccauugauuguggauucaaugaccugucccaauuacauuguucguaugaaucauucgauguggaaagugguguauacucaguuucuagcuuugaagcuaaaccuucaggaucaguuguagaacaagccgaggguguugaaugcgauuuuucaccccuacuauccggaacaccaccucagguauauaauuuuaaacguuugguauuuacaaauuguaacuacaaccucacaaaacuucuaucacuauucuccguuaacgacuuuacuugcucacaaauaucaccagccgcaauagcaucaaacugcuauuccucacuuauacuggauuacuucucuuauccuuuaucaaugaaaucugaucuaaguguuuccucagcuggacccauuagucaauucaauuacaaacagucuuuuaguaacccaacaugucuuaucuuagcuacaguuccccauaaucugaccacaauaaccaaaccccuuaaauacaguuauauuaauaaauguucccguuuacucucagacgaucguacagaaguaccucaacucgucaaugcuaaucaauauucuccuuguguauccauuguacccucuacaguaugggaagacggagauuauuaccgcaaacaguuaucuccauuagaaggagguggaugguuagucgcgaguggaagcacagucgcuaugaccgaacaacuacaaaugggcuucggcauaaccguucaauacgggacggauaccaacuccguuugcccuaaacucgaauuugcaaaugacacaaaaaucgccagccaacucgggaauugcgucgaauauagucuauauggcguuucaggacguggcguauuucaaaacugcacagcagugggaguccgccaacaaagauuuguauacgaugcauaucaaaauuuggugggauacuacucagaugacgggaacuauuacugucucagggcuuguguaucggucccuguaucuguuaucuaugauaaagaaaccaaaacacacgcaacuuuauucggaucugucgccugugagcacaucucaucgaccaugucacaauacagucgaucgacucguuccauguuaaaaagaagagauuccacuuacggcccacuacaaacaccagucggaugcguucucggccuugucaacuccucccuauuuguugaagacuguaaacuuccacuaggucaaucauuaugugcuuuaccugauacaccuaguacuuugacacccuga

SEQ ID NO: 2202 - RNA, 2244 nt, Artificial Sequence
  derived and/or modified CDS sequence (opt6) from MERS-CoV__ALJ54472__S1
augauacauagcguuuuucuauuaauguuucuccucacuccaacagaauccuaugucgacguagguccagauaguguaaagucagcauguauagaaguagauauacaacaaacauucuuugauaaaacauggccccgacccauagacguaucgaaggcugaugguauaauuuauccacaaggucgaacauacucaaacauuacuauaacuuaucaagguuuauuccccuaucaaggagaucauggugacauguauguauauagcgcaggccacgcuacuggaacaacaccccaaaaacuauucguagcuaacuacucucaagacguaaagcaauucgcaaauggauucguaguuagaaucggagccgcagcuaauucaacagguacuguaaucauuuccccuaguaccucggcaacgauuagaaaaaucuaucccgcguuuaugcuagguucaagcgucggaaacuucagcgacggaaaaaugggucgauucuuuaaccacacgcuaguacucuuaccagauggauguggaacauuauuaagagcguuuuacugcauacuagaaccacgcagcggaaaccauuguccggcaggaaauucauauacaucauuugccacauaccauacccccgcaaccgauugcucagauggaaauuauaaucgcaaugcaucacuuaacaguuuuaaggaauauuuuaaccuaagaaacuguacuuuuauguacacauauaauauuacagaagaugaaauucucgaaugguuuggcauaacacaaacugcucaagguguacaccuauuuucaucucgauacguagaccucuacggugguaauauguuccaauuugcaacguuacccguuuaugauacaaucaaauacuauucaaucauaccccacuccaucagaucaauacaaucugacagaaaggcaugggcggcauucuaugucuacaaacuccaaccacuuacauuucuacucgacuucucaguugauggauauauuagacgagccauagacugugguuucaacgacuuaucucaacuacacugcucauaugagagcuuugacguggaaucaggaguuuacucaguaucaaguuuugaagcgaaaccuucaggguccguaguagaacaagcagaaggaguugaaugcgauuuuuccccacuucugucaggaacaccuccccaaguauacaauuucaaaagauuaguuuuuacaaauugcaauuauaaucuaacaaaauuacucucucuauuuucgguaaacgacuuuaccuguucgcaaauaucucccgcugcgauagcgaguaauugcuauuccaguuuaauucuugauuacuucucauaccccuuaucuaugaaaucugaccucucaguauccagugcaggaccaauuucucaauucaacuauaaacaaucuuuuaguaaucccacaugucucauacuugcaacaguaccacacaauuuaacaaccauuacuaaaccauuaaaauauucauacauaaauaaaugcucccgacuacuaucagaugacagaaccgaggucccccagcuaguuaacgcaaaccaauauaguccuuguguaagcauaguaccuuccacaguaugggaggauggcgauuauuaucgaaaacaacuaucuccccuugaaggcggcgguuggcuuguagcaucagguucaacugucgcaaugacugaacaauuacaaaugggcuucggaaucacaguccaauacggcacagauacuaacuccguaugccccaaacuugaauuugcaaacgauacgaaaaucgcuucucaacuaggaaauugcguagaauacucccuguacgguguaucuggaagaggaguauuucaaaacuguacagccguagguguauuacaacaaagauuuguauaugaugccuaccaaaaccugguaggauauuauucagaugaugguaacuauuauugucuccgggccugcguaucagucccaguuuccguaauuuacgacaaagaaacuaaaacgcaugcaacacuuuucgggucaguagcaugugaacacauaucuucuaccaugucucaauauuccagaucaacacgaucuaugcuaaaacgucgugacucgacuuauggaccacuacaaacaccaguuggcuguguucuaggacuuguuaauucaucuuuauucguagaagacugcaaauuaccucucggacaaucauuaugugcacucccugauacucccucuacccuagcucccuaa

SEQ ID NO: 2203 - RNA, 2244 nt, Artificial Sequence
  derived and/or modified CDS sequence (opt6) from MERS-CoV__ALJ54474__S1
augauucauucaguauuuuuauuaauguuucuucuuacaccaacugaauccuacgucgauguaggaccagacucgguaaaaucagccugcaucgaaguagacauacaacaaaccuucuuugauaaaacuuggccacggcccauagauguaucuaaagcagaugguauaauuuauccacaaggaagaacauacaguaauaucaccaucacauaucaaggucuauuuccuuaucaaggagaucauggugacauguauguuuacucagcuggccaugcaacaggaacaacgccacaaaaacuauucguugcuaacuauucacaagaugucaaacaauuugcaaacgguuucguaguucguauaggcgcugcugcuaacaguaccggaaccgugauaauaagccccucuaccucagcaacaauaagaaagauauauccagcauucaugcuuggaagcuccguuggaaauuuuucggaugggaaaaugggacguuucuuuaaucacacacucguucuauuacccgacggauguggcacauuacuacgcgcauuuuacugcauucuugaaccaagaagugguaaucacugcccagccggcaacucuuacacuucauuugcuacauaucauacucccucaacugauuguagcgacgguaauuauaauagaaacgccucacucaauucuuucaaagaauauuucaaucuaagaaauuguacuuucauguauacauacaacauaacagaagacgaaauacuagaaugguucgggauaacacaaacagcacaagguguacaucuauuuaguucacgcuauguagaccuauauggcggcaauauguuccaauuugcaacacuuccaguuuacgacacuauuaaauauuauucuauaauuccacauucaauacgaucgauacaauccgauaggaaagcaugggcugcuuucuacguauauaaacuucaaccccucacauuccucuuagauuuuucaguugauggauacauucgucgcgcgauugacugugguuuuaaugauuuaagucaauuacauugcucauacgagagcuuugacguagaaucugguguauacucaguuagcucauuugaagcaaaaccauccggaucugucguugaacaagccgaaggaguagaaugcgauuuuucaccauuauuaucagguacaccaccacagguuuauaacuuuaaacgauuaguauuuacuaacuguaacuacaauuuaacuaaacuccuuagcuuauuuuccguaaacgacuuuacgugcucacaaauaucgcccgccgcuauugcuucaaacuguuacagcagccuaauauuagauuauuuuucauauccauuaaguaugaagucagacuuaucaguuuccagugcaggacccauaagccaauuuaauuacaagcaaucauucuccaauccgaccugucuuauccuugcaacaguuccacauaaccuaaccacaauaaccaaaccccuuaaauacucuuauaucaacaaauguucacgacuacuaucagaugacagaacugaaguaccucaauuaguuaaugcaaaccaguauuccccaugugucucaaucgucccaucaaccguuugggaggacggcgauuauuacagaaaacagcuuucacccuuagaaggugguggauggcuaguagcaucaggaucaacugucgcaaugacagaacaacuccaaaugggauuugguaucacaguacaauacgguacugauacaaauucuguuugccccaaacuagaauuugcaaaugacacuaaaauagcaucccaauugggcaauugcgucgaauauucauuguauggugucuccggacgaggaguauuucaaaauuguacagcagucgggguacgccaacaaagguucguuuacgaugccuaccaaaauuuaguaggcuacuacucagacgacggaaauuauuacugucuuagagccugcgucuccguaccuguaaguguuauauacgauaaagaaacuaaaacacacgccacacuauuuggaucagucgcaugcgaacauauaucaucgacuaugucucaauauucaagguccacacggucaauguuaaaacgacgggauuccacguauggacccuuacaaaccccaguagguugcguacucggacucguaaacaguucucucuucgucgaagauugcaaauuaccauuaggacaauccuuaugugcacuccccgauacuccuuccacuuuaacuccauaa

SEQ ID NO: 2204 - RNA, 2244 nt, Artificial Sequence
  derived and/or modified CDS sequence (opt6) from MERS-CoV__ALJ54483__S1
augauccauagcguauuccuuuuaauguuccuauuaacuccuacugagucauauguugauguuggaccagacagugucaaaucugcauguaucgaaguagauauccaacaaacauucuucgacaaaacauggcccagaccuauagauguuucuaaggcagacggaauuaucuauccacaaggucgcacauacucaaauauaaccauuacguaucagggacuuuuuccauaccagggagaucauggagauauguauguguauucggcagggcacgccaccggaacaacaccacaaaaacuauuugucgcaaacuacucacaagaugucaaacaauucgcgaaugguuuuguaguuagaaucggagccgccgccaauucuacaggcaccguuauaaucucacccucaacuucugcuacuauacgcaaaauauauccagcauucaugcuaggaagcucaguaggaaauuucucagauggcaagaugggaagauucuucaaucauacccuaguucuacuuccagacggcugcgguacccuacuccgagcauuuuauuguauacuagaaccaagaagcggaaaucauuguccugcaggaaauucauacacuucauuugcaaccuaccauacaccagcgacagacugcucagauggaaauuacaauagaaaugcauccuuaaacucauuuaaagaauacuuuaauuuaagaaacugcacauucauguacacauacaacauaacagaagacgaaauccuagaaugguuuggaauaacccaaacugcacaaggcguacaucuauucucaucucguuauguagaccuauauggaggaaauauguuccaguucgcuacacuaccaguauaugauacuauaaaauauuacaguauaaucccccauucaauucgcucaauacaaucagaccgaaaagcgugggccgcguuuuaugucuacaaacuucaaccauuaacuuuucuuuuagauuucaguguagauggguauauacgucgcgcaauagauuguggauucaaugauuuaucacagcuucauuguaguuacgagucuuuugauguagagucagguguuuauagugucuccagcuucgaggcaaaaccaagcggauccgucguugaacaagcagaaggaguagaaugugauuuuucaccccuccucucagguacuccuccccaaguauauaacuucaaacgucuuguauucacaaacugcaacuacaaccuuacaaaacuauuaucucucuuuucagucaaugacuuuacauguucucagaucaguccagcagcuauugcuuccaauugcuauucaucccuaauuuuggauuacuuuaguuauccauuaucuaugaaaucagaucuuuccguuagcucagcuggaccgauauuucaauucaauuauaaacaguccuuuucaaauccuaccugccucauuuuggccacgguaccccauaaccuaacuaccauaacuaaaccauuaaaauacucauacauaaacaaaugcucccgcuuacuuagugacgacagaacugaaguuccgcaacugguaaacgcaaaucaauauucaccaugcguauccauaguuccaucaaccguaugggaagauggcgauuacuaccgaaagcaauuauccccauuagaaggcggugguugguuaguagcgucaggcucuaccguagccaugacagaacaacuacaaauggguuucgguaucaccguccaauacgguacagacacaaacucaguauguccaaaacuagaauuugccaaugacacuaaaauugccucucaauuaggaaacugugucgaauauuccuuauacggcguaaguggcagaggagucuuccaaaauuguacagccguugggguuagacaacaaagauuugucuaugacgccuaccagaaccuagucgguuauuauucagacgacgguaacuacuacugcuuacgagcaugcguuucaguaccagucuccguaauuuaugauaaagaaacuaaaacccaugcgacccuauuugguaguguagcaugcgaacauauaucuuccaccaugagccaauacucccgaucaacaagaucaaugcucaaaagaagagacucaaccuacggcccccuucaaacaccaguaggauguguauuagguuugguaaacucaucucucuucguugaagacugcaaacuuccauuaggacaaucacuaugcgccuuacccgacacucccucuacccucaccccuuga

SEQ ID NO: 2205 - RNA, 2244 nt, Artificial Sequence
  derived and/or modified CDS sequence (opt6) from MERS-CoV__ALJ54486__S1
augauucauucugucuucuuacuuauguuucuacucaccccaaccgaaucauacguugacgucggaccugauagcguuaaaucagccuguauagaaguagauauacaacaaacauucuuugauaaaacuuggccccgaccaaucgauguaucaaaagcagauggcauaauauacccucaaggcaggacuuauucaaacauuacaauaacuuaccagggccuguuuccauaccaaggagaccacggagacauguacguuuauucugcgggccaugcaacuggcaccacaccccaaaaauuauuuguagcaaacuacagccaagauguuaaacaguucgcuaauggcuuuguaguacgaauaggagcagcagccaauuccacagguacaguaauaaucaguccaagcacaucagcaacaauacgcaaaauuuauccugcuuuuauguuaggcuccucaguuggaaacuuuagugacggcaaaaugggacgcuuuuucaaccacacccucguacuacuuccugauggaugcggaacuuuauuaagagcauucuauugcauuuuagaaccaaggagugguaaccacuguccagcgggaaauucauacacauccuuugccacauaccauacaccagcuacugauuguuccgacgggaauuauaaucgcuacgcaucacucaacucuuucaaagaauacuuuaauuuaaggaauugcacauuuauguauacauauaacauuacagaagacgaaauacuugagugguucggaauaacucaaaccgcgcaaggaguccaccuauuuuccagccgauacguagaccucuacgggggaaauauguuucaauucgcuacucuuccaguuuacgauacaauaaaauauuacucuauaaucccucacaguauucgaucaauucaaagcgaucgcaaagccugggcagcauuuuacgucuauaaauuacaaccacuaacguuucugcucgauuucucaguagauggauacauaagacgugcaaucgauuguggauucaaugacuugucacaacuucacugcucauaugaauccuucgacguagaaucagguguguauucuguaucaucauuugaagccaaaccuaguggaaguguugucgaacaagcugaagguguagaaugugauuuuucaccacuucuuucugguacaccaccacaaguauacaacuuuaagcgacuuguauucacuaauugcaacuauaacuuaacaaaacuccuaucauuauuuuccguaaaugacuucacauguucucaaauaagcccugccgccauagcaaguaacugcuacuccucacuaauccuagauuacuuuuccuauccauuauccaugaaaucugacuuaucuguuaguucugcagguccuauaucacaauucaauuauaaacaauccuucucaaauccaacgugcuuaauacuugccacugucccacacaaucuaaccaccauaacuaaaccauuaaaauacucuuauauaaauaaguguucucgccuacucuccgacgaucgaaccgaaguaccucaguuaguaaaugccaaucaauauaguccauguguauccauaguaccuucaacaguuugggaggauggagacuauuaucguaaacaauuaucuccccuagaagguggaggauggcuugucgucuccgguucuacugucgccaugacagaacaauuacaaaugggauucggaauuacuguacaauacggcacagauacuaacucaguaugucccaaacuagaauuugcaaacgacacuaaaauagcgagccaacucgggaauugcguagaauauucuuuauacggugucuccgguaggggcguauuucagaacuguacugcaguaggaguccgacaacaaagauuuguuuacgacgcauaccaaaaucucgucggauacuauagugacgacggaaauuacuacuguuuacgagcaugcguaucagugcccgucucuguuauauacgauaaagaaacuaaaacccacgcaacauuauuuggcucagucgcaugcgaacauauaucuucaaccaugucgcaauauucaagaucuacaagaucgauguuaaaacgaagagauagcacauacggcccacuucaaacaccgguugguugugucuuaggauuaguaaacuccucccuauuuguugaagauuguaaacuaccauuaggacaaagccuaugugcuuuaccagacacacccucaacauugacuccauga

SEQ ID NO: 2206 - RNA, 2244 nt, Artificial Sequence
  derived and/or modified CDS sequence (opt6) from MERS-CoV__ALJ54488__S1
augauucacucaguauuccuucuaauguuuuuauuaacucccaccgagaguuauguagacguuggaccugacucagucaaaucagcauguauagaaguugauauacaacaaacuuucuuugacaaaacauggccgaggccaauugauguaucuaaagcagacggcauaaucuauccacagggaagaacauacucuaauauuacaauuacuuaucaagguuuauuuccauaucaaggcgaccacggagacauauauguauauagcgcaggucacgccaccggcacaacaccacagaaauuauuugucgcgaauuauucacaggauguaaaacaauuugcaaauggauucguaguucguaucggugcugcggcgaacucaacaggaacaguaauuauuucacccaguacuagcgcuacgauacgaaaaauauauccggccuuuauguuagguucuucgguuggcaacuuuucagauggaaaaaugggacgcuucuucaaucacacuuuaguuuuauuaccagacggauguggaacacuauuacgagcauuuuauuguauacuugaaccacgaagcgguaaccauuguccagcaggaaauaguuacacgucuuuugcaacauaccacaccccugcgacagauuguucagacgguaauuauaacagaaacgcuucacuuaacucguuuaaagaauauuuuaaccuaagaaauugcacuuuuauguacacauauaacauaacugaagaugaaauauuagaaugguuuggaaucacucaaacagcccaaggcguucaccucuuuagcucccgauaugucgaccuauauggaggcaauauguuccaauuugcgacucuacccgucuaugauaccauaaaauauuauucaaucauuccgcacucaauacggucaauucaaagugauagaaaagcaugggcagcauucuauguauauaaauuacaaccucuuacauuucuacuagauuuuaguguugacggcuauauacguagagcuauugacugcggcuuuaaugacuuaucacaauuacacugcucauaugagucuuucgauguagaaagcggugucuauaguguauccuccuucgaagcuaaaccuagcggaaguguugucgaacaagcugaaggaguagaaugugacuuuucaccccugcucucaggcacaccaccccaaguuuauaacuuuaaaagauugguuuucacuaacugcaauuauaaccuaacaaaacuucuuucuuuauuuucaguaaaugauuuuacauguagucaaauuucaccagcagcaauugcaucuaauuguuacagcagcuuaauauuagauuauuuuaguuauccccuuucuaugaaaagugaucuuagcgucuccucugccggaccaauaucgcaauuuaauuacaaacaaucuuucucaaauccuacaugucucauucuugcuacugucccucacaauuuaacuacgaucacaaagccauuaaaauacucauacauaaacaaauguucaagauuacugucugacgacagaacugaaguaccccaacuuguaaaugcuaaucaauacucuccaugugucaguaucgucccaucuaccgucugggaagacggagacuauuauagaaaacaauuaucuccuuuagaaggagguggaugguugguagcaagcggaucaacagucgcaaugacagaacaauuacaaauggguuuuggaauuacaguccaauacggaacggauaccaauaguguuugucccaaauuagaauuugcaaaugauacuaagauagcuucucaguuaggcaauugcguagaauauucucuauauggagucagugguagaggaguuuuccaaaacuguacagcaguaggaguuagacaacagagauucgucuaugaugcuuaucagaauuuaguggguuauuacucagacgaugguaauuacuauugucuaagagcaugugucuccgugccugucucagucauauaugauaaagaaacaaaaacucaugcaacacuauucggaucugucgcaugcgaacauauuucauccacuaugucucaauacucacgaucaacccgcucuaugcuaaaaagaagagacucuacuuauggacccuuacaaacuccuguaggaugcguacucggucucguuaauuccucgcuauucguagaagauuguaaauuaccuuuaggacaaucucuuugugcauuaccagauacaccaucaacacuuacuccuuaa

SEQ ID NO: 2207 - RNA, 2244 nt, Artificial Sequence
  derived and/or modified CDS sequence (opt6) from MERS-CoV__ALJ54490__S1
augauccauucuguguuuuuacuaauguucuuguuaacaccaacagagagcuauguagauguugguccggauucagucaaauccgcuuguauagcaguagauauccaacaaacauucuuugacaaaacauggccucgcccuauugauguaucuaaagccgacggaauaauauauccacaaggacguaccuacucaaauauaacaaucacuuaucagggacuauuuccauaucaaggcgaucauggagauauguacguguauucagcaggccaugccacagguacaacaccacaaaaacuuuuuguagcaaacuacagucaggauguuaaacaguuugccaaugguuuugucguucgaauaggagccgcugcaaauucaacagguacgguuauaaucagcccaucaacgucagccacaaucagaaaaaucuauccagcguucauguuaggaucuagcgucggaaacuuuagcgauggaaagaugggucgauucuuuaaucacacucuaguauuacuucccgauggguguggcacauuacuacgagcuuucuacuguauucucgaacccagauccgguaaccauugcccagcagguaacaguuauacaaguuucgcaacauaccauacacccgcuacagacuguucagauggcaacuauaaucgaaacgcuucccuaaacucauucaaagaauauuuuaacuuaagaaauuguacuuucauguacacauacaacaucacagaagacgaaauuuuagaaugguucggaaucacacaaacugcacaaggaguacacuuauuuagcucaagauacguagaucucuauggugggaacauguuucaauuugcaacacuacccguauaugacacaauuaaauauuauaguauaauaccacauaguauacguucaauacaaucagacagaaaggcaugggccgcuuucuauguauauaaacuacaaccucuaacauucuuacuagauuucucuguugacggauauauuagacgugccaucgauugcggauucaaugaccuaucucaguuacauugcaguuacgaguccuuugacguugaaucaggcguauauucugucucauccuuugaagcuaaaccauccggaagcguaguugaacaagcagaagguguugaaugcgauuuuuccccuuuacuuagcggaacaccuccccaagucuacaauuucaaacgucucgucuuuacaaacugcaauuacaaucuuacaaaauuacuaucacuauucucaguaaaugauuucacaugcagccaaauaucaccagcagccauugcaucaaacugcuauucgucgcuaauauuagacuauuucucguaccccuuaucuaugaaaagugaucuaaguguaagcucagcagguccgauuucccaauucaauuauaaacaaucuuuuuccaaucccacuugccuuauacuagcaacaguuccgcauaacuuaacuaccauuacaaaaccccucaaauacucauauauaaacaaauguucacgacuccuaagugauggccgcacugaaguuccacaacucgucaacgcaaaucaguauuccccauguguaucaauagugccuuccaccguaugggaagauggagacuacuaucgcaaacaauuauccccuuuagaagguggaggaugguuagucgcgucgggcuccacugucgcaaugacagaacaauuacaaaugggauucggaauaacuguacaauacggaacagauacgaacucuguaugcccuaaauuagaauuugccaacgacacaaaaauagcaucucaacuuggaaauugugucgaauauuccuuauauggcgucuccggacgcggcguuuuucaaaacugcacagcagucggaguuagacaacaacgcuuuguauacgacgccuaccaaaacuuagucggcuacuacucugacgacggaaacuacuauuguuuaagagccugugucagcgucccagucucaguaauauacgauaaagaaacaaaaacacaugccacccucuucggaucaguugcgugcgaacacauuucaucuacaaugucacaauacaguagaucaacacgaucuaugcucaaacguagagauagcacauauggaccuuuacaaacaccuguaggcuguguacuuggccugguaaacucaucacuauuugucgaagacuguaaauuaccacuuggucaaucccuuugcgcuuuacccgacacaccaucaacucuaaaaccauaa

SEQ ID NO: 2208 - RNA, 2244 nt, Artificial Sequence
  derived and/or modified CDS sequence (opt6) from MERS-CoV__ALJ54495__S1
augauucauucuguuuuucuuuugauguuucuccuuacaccaacagaaaguuauguagacguaggcccagacaguguaaaaagugccuguaucgaaguagauauacaacaaacauucuuugacaaaacuuggccgagaccaauagacguaaguaaagccgacggcauaauauacccucaaggacgcaccuauucuaauauaacaauaaccuaccaaggauuauuuccauaucaaggcgaccacggugacauguacguauauuccgcaggccaugcaaccggcacuaccccacagaaacuauuuguugcuaauuauucacaagacguaaaacaauuugcaaacggguuuguagugagaauuggcgcugccgcuaauucaacaggaacaguaauaauaucaccaucuacaucugcaacuauacgaaaaauuuacccggcauuuaugcuaggaagcucugucgguaauuuuucugaugguaaaauggggagauuuuucaaucacacguugguucuucuaccagacggaugcggcaccuuacucagagcauuuuauugcauacucgaaccacgcucagggaaucacuguccugccggaaacucuuauacauccuucgcaacauaccacaccccugcuacugauugcucugacggaaauuacaaccgaaacgcauccuuaaauucuuuuaaagaauauuuuaaucuuagaaauugcacguucauguauacauacaauauuacagaagacgagauauuagagugguuugggaucacucaaacugcacaaggagugcacuuauuuucauccagauauguugauuuauacggagguaauauguuucaauuugccacacuaccagucuacgacacgauaaaauauuauuccauaauaccucauucaauucgaucaauccagucugauagaaaagcaugggcagccuucuauguauauaaacuacaaccacuuacauuccucuuagauuucucaguagauggcuauauacgucgcgcaauugauuguggcuuuaaugacuuaucucaacuucacugcucauacgagaguuucgauguugaaucggguguauauucgguuuccuccuuugaagcuaaaccuucagggucaguuguagaacaagcagaagguguagaaugugacuucucaccacuacuuucagggacucccccacaaguauacaauuucaaacgacuuguuuuuacaaauuguaauuauaaucuaacaaaauuacuuucuuuauuuaguguaaacgauuucacuuguagucaaauuaguccggccgcaauugcaucuaauugcuauucaucucucauucuggauuacuuuuccuacccauuaagcaugaaaucagauuuaaguguuagcagugcugguccaaucucccaauucaacuacaaacagagcuuuucaaauccuacauguuuaauauuagcuacuguaccacauaaucuuacaaccauaaccaaaccuuuaaaauacucuuauauaaacaaaugcaguagacuacuaucugacgacagaacugaaguuccacagcuaguaaacgcuaaccaauacucaccauguguaucuauagucccaucuacaguaugggaagauggugauuacuaccgcaaacaacuaucgccacucgaagguggagggugguuagucguuuccggaucuaccguagcaaugacugaacaacuucaaauggguuucggaauaacaguacaauacggaaccgacacuaacagcguauguccaaaauuagaguucgcuaaugacacaaaaauagccucucaacucggaaacuguguugaauauucucucuauggaguauccggacgaggaguauuucaaaacugcacagcuguaggaguacgccaacaaagguuuguguaugaugcauaccaaaacuuaguuggauacuauagcgaugacgguaauuacuauugcuuaagagcauguguaucagucccaguaucaguaauuuaugauaaagaaaccaagacgcaugccacacucuuuggauccguugcgugcgaacauauuuccucuaccaugucacaauauucacguucaacucguuccaugcuaaaacgcagagacucuacauacggaccauuacaaacaccaguuggaugcguccuaggucuuguaaauucuucucuauuugucgaagauuguaaauuaccuuuaggacaaucccuuugcgcucuaccagacacucccuccacucuuacacccuga

SEQ ID NO: 2209 - RNA, 2244 nt, Artificial Sequence
  derived and/or modified CDS sequence (opt6) from MERS-CoV__ALJ54496__S1
augauacacaguguauuuuuacuaauguuccuuuuaacucccaccgaaucauauguugauguaggaccagauucaguaaaaucagccuguauagaaguagacauacagcaaacauucuuugauaaaacuuggccucgaccaauugacguaaguaaagcagauggaauuauuuauccccaaggucgaacauacaguaacauaacaauuaccuaucagggucuauuuccauaucaaggugaucacggagacauguacguuuacucugcaggucaugccacaggcaccacuccacaaaaacuauuuguugcuaacuacucacaagaugugaaacaauuugcaaauggauuuguuguaagaauaggagcagccgcaaauagcacagguacuguuauaaucucaccaagcacaagugcaacaauucgaaaaauuuacccagcauuuauguuaggaucaagcguaggaaauuucagcgacggaaaaaugggaagguuuuucaaccacacauuaguacuacuaccagacggcuguggcacauuauuaagagcauucuacugcauacucgaaccucgauccggaaaccacugcccagccggaaacucauauacuagcuuugccacauaucauacaccagcaacugacuguucugacgguaacuauaaucguaaugcuagccuuaacucauuuaaggaauacuucaaccuaagaaauuguacuuuuauguauacuuacaauauaaccgaagaugaaauucuagaaugguucgguaucacacaaacugcccaaggaguacaucuguuuucaagccgauauguugaucuauacgguggaaauauguuucaauuugcuacuuuaccuguauacgauacaauaaaauauuauucuauuauaccucauucuaucagaucaauucaaucagacaggaaagccugggccgccuuuuauguauacaaauuacaaccauuaacauuucuucuugacuuuucugucgacggcuauauccgcagagcgauugauugcggcuucaacgaucugucucaacuacacugcucuuacgaaucuuuugacguagaaucuggaguauauucaguuagcucauuugaagccaaaccaucuggguccguaguagaacaagcagaagguguugaaugcgauuucaguccacuucucucaggaacuccuccccaaguauacaauuuuaaaagauuaguuuuuacaaauuguaacuauaaucuaacaaaauuacuuucacuauuuucaguaaacgauuucacuuguagccaaauaaguccggcagcuauagcaaguaauugcuacucaucacucauacuagacuacuucucauaucccuuaaguaugaaaucagauuuaagcguuucuuccgcuggcccuauaucacaauuuaauuauaaacaaucauuuuccaacccaacuugucuuauucuugcaacaguuccgcauaaccuaacaacuauuacuaaaccauuaaaauacucuuacauaaacaaauguucaagacuaccaagugacgacagaacugaaguaccccaauuagucaacgcuaaccaauacucuccuugcguuucuauaguacccucuacuguaugggaagauggagauuauuauagaaaacaacuuucaccacuagaaggaggggguugguugguagcaucggguucaacaguagcaaugacugaacaacuccaaauggguuucggcaucacuguccaauaugguacagauacaaauagcguauguccaaaacuagaauuugcaaaugauaccaaaauagcuucacaauugggaaauugcgucgaauauagucucuacggaguuucaggccgcgggguauuucaaaauugcacugcuguaggugucagacaacaacgauuuguuuacgaugcauaccagaaucuugucggcuacuauucugacgaugguaacuacuacugucuuagagcaugcgucuccguaccuguaucaguuaucuaugacaaagagacgaaaacacacgcuaccuuauuuggaucuguugccugugagcauauaagcucaacuaugucacaguacagcagguccacacgaagcaugcuaaaacguagagauucaacauacgguccacuccaaacacccguuggauguguucuuggccuaguaaauucaucccuauuuguagaagacuguaaauuaccauuaggacaaucauuaugugcccuaccugauacuccaucgacacuaaccccauag

SEQ ID NO: 2210 - RNA, 2244 nt, Artificial Sequence
  derived and/or modified CDS sequence (opt6) from MERS-CoV__ALJ54500__S1
augauacauucaguuuuccuccuaauguuuuuacuuacucccacagaguccuauguugauguagggccagacagcguuaagagcgcauguauugaaguagacauacaacaaacauucuuugauaaaacauggccacgaccaauugacguaaguaaagcagacggaauaaucuauccacaaggaagaacauacuccaauauaacuaucacguaucaaggccuauuuccuuaccaaggagaucacggugacauguacguauauuccgcaggacaugcaaccgguacgacgccacaaaaauuauuuguagcaaacuacucucaagacgucaaacaauuugcaaacggguucguaguaaggauaggagcagcagcuaauucaacaggaaccguaauaauaucuccuucaaccucggccacaauacguaaaauauauccggcauucauguuaggcucaucgguuggaaauuucucagauggaaaaaugggaagauucuuuaaccauacucuuguauuacugccugauggauguggcacccugcuacgagcauuuuauugcauacuugaacccagaagugguaaucauugcccagcaggaaauucauacacauccuuugcaacuuaccauacaccagccacggauuguucagacggaaacuacaaccggaaugccuccuuaaacucuuuuaaggaauauuuuaaccucagaaauugcacauuuauguacaccuauaauauuacugaagaugaaauauuagaaugguuugguauaacucagaccgcccaagggguucauuuauuuucaaguagauauguagacuuauaugguggcaauauguuccaauuugcaacguuaccagucuaugauacaauaaaauauuauucuauaauuccucauucaauaagaucaauucagagugaucgcaaagcaugggccgcuuucuacguauacaaacuacaaccacuaaccuuucuauuagacuucucagucgauggauacauucgucgcgcgauugacugcggcuucaacgauuuaucccaauuacauugcucuuacgaaucauucgacgucgagucugguguuuacucagucucuucauuugaagcaaaaccaucaggcaguguagucgaacaagcggaaggaguugaaugcgauuucuccuuauuauuaucaggcacuccuccacaagucuauaauuucaaaagauuaguauucaccaacuguaacuauaacuugacaaaauuacuuucauuauucucuguuaacgauuucacuugcucucaaauaucuccugccgccauagcaagcaauugcuauaguucuuuaauucuugauuacuuuuccuauccauuaucaaugaaaucugaucuuuccguuucuucggcaggaccaauuucacaguuuaauuauaaacaaucauuuuccaauccaacaugucuaauacucgcuaccguaccacacaacuuaacaacuauuacaaaaccccuuaaauacucguacauuaauaaauguucuagacuacucucugacgauaggacagaagucccucaauugguaaacgcaaaccaguacucuccuuguguaaguauuguaccaucaacaguaugggaagacggagacuauuauagaaaacaauuaucuccacuugaagguggaggcugguuaguugcauccggaucaacaguugcuaugacagaacaacuucagaugggcuucggcauaacaguacaauauggaacagauaccaauucaguuugcccuaaauuagaauuugcaaacgacaccaaaauugcaagccaauuaggcaauuguguagaauacucacuauauggaguaucuggccgcggcgucuuccaaaacuguaccgcaguagguguaagacaacaacguuuuguauaugaugcauaucagaaucucgugggcuauuacucggaugaugguaauuacuacugccuucgagcaugugucucaguaccaguuucuguaauauaugauaaagaaacaaaaacacaugccacucucuucgguucaguugcuugcgaacauauuucaucaacaaugagccaauauucacguagcacccgaucaaugcuaaaaagacgugauucaaccuacgguccucuccagacaccgguuggauguguuuugggauuaguuaauucuuccuuguucguggaagauugcaaacuaccacucggacaaucauuaugcgcuuuaccagauacaccuagcacacucaccccauaa

SEQ ID NO: 2211 - RNA, 2244 nt, Artificial Sequence
  derived and/or modified CDS sequence (opt6) from MERS-CoV__ALJ54501__S1
augauucauuccguguuuuuacuaauguuccucuuaacuccaacagaaucuuauguagauguaggaccugauaguguaaaaucagcauguauagaaguugauauacaacaaacauucuuugauaaaacauggccuagaccuauugacgucaguaaagcagacggaauuauauauccacaaggacguacauauucuaauaucacaauaacuuaccaaggauuauuucccuaucaaggagaccacggugacauguauguuuacagugcaggccacgccaccggcaccacaccccaaaaacucuuuguagcaaauuacucacaagacgucaagcaauuugcaaacggauucgucguucgaauaggggcugccgcaaacucaacagguacugugauuauuucaccaucaacuucagcaacgauaagaaaaauauaucccgcauuuauguuaggaagcaguguaggcaauuuuagugauggcaagauggguagauuuuucaaucacacucuuguccucuugccugauggauguggaaccuuauuaagagcauucuauuguauuuuagaaccaagauccggcaaucauugucccgcaggcaacucguauacuucuuucgcuacauaccauaccccagcuacugacugcucagauggaaauuauaaucgaaaugcaucacuaaauagcuucaaggaauacuucaaccuacgcaauugcacuuucauguacacuuauaauauuacagaagaugaaauacuagagugguucggaauuacucaaaccgcucaaggaguucaccuauuuucuucaagauaugucgacuuauacggcggaaacauguuucaauuugcuaccuuaccagucuacgauacaauuaaauauuacuccauuauaccacauucgauucgaucuauucaaucagaccguaaagcaugggcagcauucuauguauauaaacuucaaccgcuuaccuuucuucuugauuucucugucgauggauauauaagacgugcaaucgauugugguuuuaacgacuuaucucaauuacacugcucauacgaaucauucgauguugaaucagguguauauaguguaucaucauuugaagccaaaccaucaggcuccgucguagaacaagcagaaggaguagaaugugacuucagucccuuauuauccggaacaccaccucaaguuuacaauuucaaacgcuugguauucacaaauugcaauuauaauuuaaccaagcuauuaucucuuuuuaguguuaaugacuuuaccugcucacagauauccccagcagcaauugcaucuaacugcuauucaucccuaauucuagauuauuuuaguuauccacuauccaugaaaagcgaccuaucaguauccuccgcaggaccuauaucucaauucaacuauaaacaaucuuucucaaacccaacaugucucauacucgcaacuguaccacauaaucuuaccacaauaacaaaaccucuaaaauauagcuauaucaauaaaugcucccgacuucucucagaugacagaacugaaguaccucagcuaguuaaugcuaaccaauacucacccugcguguccaucgucccaaguacacuuugggaagacggggacuacuauagaaaacaauuaaguccacuagaaggaggagguuggcuaguugcaucaggcucaacuguagccaugacagaacaacuccaaaugggauuuggcauaacagugcaauauggaaccgauacaaacaguguaugcccuaaguuagaguuugcaaaugacacaaaaauagcgucacaauuaggaaacuguguagaauauucauuauauggugucaguggcagaggcguauuucaaaauugcacagcugucggaguucgccaacaacgguuuguauacgaugcguaucaaaaucucguaggauauuacucugaugacggcaacuauuauugucuccgggccugcguuucuguccccguaucaguaauuuacgauaaagaaacaaaaacucaugcaacucuauuugggucuguagcaugcgaacacauaucaagcacaaugucacaauacucaagaucaacaagaucaaugcuuaaaagacgugacucaaccuaugggccacuacaaacaccaguuggauguguauuaggucuaguuaauuccaguuuauuugucgaagacugcaaacuaccgcuaggucaaucccucugugcccucccagacaccccauccacuuuaacacccuaa

SEQ ID NO: 2212 - RNA, 2244 nt, Artificial Sequence
  derived and/or modified CDS sequence (opt6) from MERS-CoV__ALJ54502__S1
augauucauucaguauuucuuuuaauguuuuuauuaacacccacagaaaguuauguugacguagguccagauucaguuaaaucagcguguauagaagucgauauacaacaaacauucuuugacaaaacauggccuagaccuauagacguaucaaaagcugaugguauaauauauccacaagguagaacuuacucaaauaucaccaucacuuaucagggacuuuuuccauaucaaggcgaucauggagacauguaugucuauagcgccggucacgcuacuggaacaacgccucaaaaacuauuuguagcuaacuauagccaagaugucaaacaauuugcaaacggauucgucgucagaauuggugcagcugcaaacucaaccgguacaguaauaauaucacccucuacgucugcaacuauucgcaaaauuuauccagccuuuaugcuaggaucauccgucggaaauuuuucugaugguaaaauggggagauucuuuaaccauacccuaguauuauuaccugauggcugugguacacuauuacgagccuucuacugcauauuagaaccccgaagcgguaaucauugccccgcagguaauagcuauacauccuucgcaacauaccauacuccugccacagacugcuccgaugguaacuacaaucgcaacgcaagucuaaacucauucaaagaauauuucaacuuaagaaacuguacguuuauguacacuuacaacauaacugaagaugaaauacucgaaugguuugguaucacccaaaccgcacaaggcguacacuuauucuccucacgguaugucgaccuauauggcggaaauauguuccaauuugcaacucuaccaguuuaugauaccauuaaauacuacucaaucauaccucauucuauacguuccauacaaucagacagaaaagcaugggcagcauuuuauguauauaaauuacaaccacuuacauuuuuauuagauuuuaguguagauggcuauauacguagggccaucgacugcggauuuaacgaccuuucacaacuacauugcaguuaugaaaguuuugauguugaauccgguguuuauaguguuucauccuucgaagcuaaaccauccgguucaguaguagaacaagccgaaggaguugaaugcgacuucuccccacuucuuaguggaacucccccacaaguauacaauuuuaagcgauuaguauucacaaacuguaauuacaaccuaacaaagcuguugucacuuuucucgguuaaugauuucacuuguucacaaauaucccccgcugcaauagcaucaaauugcuauucuucucuuauacuugauuauuucucuuacccucucuccaugaaaucagauuuguccguuucaucugcaggaccuauaucccaauucaacuauaaacaaucauuuagcaaucccacuugccucauacuugccaccguaccacacaaccucacaacuaucacgaaaccacuaaaauauucuuauauaaacaaaugcagucguuuauuaucagaugacagaacugaaguaccucaguuaguuaaugcgaaucaguauucacccuguguuucuauuguuccaucaacaguaugggaagacggcgacuacuaccgaaaacaacucaguccacuugaagguggaggauggcuuguagcaucaggaucaacugucgcaaugacagaacaacuacaaaugggauucggaauuacgguacaauauggaacugauacaaauucuguuuguccaaaauuagaguucgccaacgauacaaaaauugccagucaacuugguaauuguguugaauacuccuuauacgguguaucaggacgcggagucuuucaaaauugcacagcaguuggcguuagacaacagagguuugucuacgaugccuaccaaaacuuagucggauauuacucugaugauggaaauuacuauugccuucgagcauguguaagcguuccugugucaguaauuuacgauaaagaaacaaaaacccaugcuaccuuauuugggucaguugcaugcgaacacaucucaucaaccaugucacaauacucaagaucaaccagaagcauguuaaaacgacgagacuccacauacggcccuuuacaaacuccuguuggcugcguacucggcuuaguaaacaguuccuuauuuguugaagauugcaaacuaccauuaggucaaucauuaugcgcacucccggacacaccuucaacucuuacgcccuaa

SEQ ID NO: 2213 - RNA, 2244 nt, Artificial Sequence
  derived and/or modified CDS sequence (opt6) from MERS-CoV__ALJ54512__S1
augauccacagcguuuuucuacuaauguuuuuauugacccccacagaaucuuacgucgacgucggaccugacucaguaaaauccgccugcaucgaagucgauauacaacaaacauuuuucgauaaaacuuggccacgacccaucgaugucucaaaagcugauggaauaaucuauccacaaggacggacuuacucaaacauaacuaucacauaucaaggucucuuuccauaccaaggagaucauggugacauguauguauacucggcuggacacgcaacaggaacaacaccacaaaaacucuucguagcaaauuacucucaggauguaaaacaauuugccaauggauuuguuguccguaucggagcagcagcaaacucaacugggacaguuauaaucucacccucuacgagcgcaacuauucgcaaaauuuauccugcauuuaugcucggaagcucagucgguaauuuuuccgauggaaaaaugggacguuucuuuaaccauacccucguuuuauugccagauggaugcggaaccuuauuaagagccuuuuauugcauacucgaaccacggagcggaaaccacuguccagcuggcaauuccuauacaucauuugccacauaccacacaccagcuacugauugcagcgacggaaacuauaauagaaacgcaucgcuuaauagcuucaaagaauacuucaaccucagaaauugcacuuucauguauacauacaauaucacagaagacgaaauccuugaaugguucggaaucacacaaacugcacaaggugcacaccuauuuucuucaagauacgucgaccuauauggagguaacauguuccaauucgcuaccuuaccagucuaugauacaaucaaauacuauucuauuauaccucauagcauaagaucaauccaaucagacagaaaggcuugggcugcuuucuaugucuauaaauuacagccucuuacauuuuuacuagauuucuccgucgacggauauauucgacgugccaucgauuguggauucaacgaucuaucccaacuucacugcucauacgagagcuucgacguagaaucaggaguauacaguguaucuucuuucgaagccaaaccaucagguucaguaguagaacaagcagaaggcguugaaugcgauuuuucaccucuucuuagugggacuccuccacaagucuacaauuucaaaagacuuguuuucacaaauuguaacuauaacuuaacaaaacuauuaucauuauuuagcguaaacgauuuuacaugcucacaaauauccccugcagcaauagcuucuaauugcuacucaucucucauauuagacuacuucaguuaccccuuaucaaugaaaucugaucuuucgguuuccagugccggaccaauuucucaauucaacuauaaacaaucuuuuagcaauccgacaugucuaauacuagccacugugccucauaaccuaacaacaauaacaaaaccauuaaaauauucuuauaucaauaaaugcagucgauuauuaucagacgauagaaccgaagugccucaauuaguuaaugcaaaccaauacagucccuguguaucuauuguaccuaguacagucugggaagauggagacuauuaucguaaacaauuaucaccacucgaaggaggaggcuggcuaguagcuuccggcucaacagucgcaaugacagaacaacuccaaaugggauuugguauaacuguucaauacggaaccgacacaaauaguguuuguccuaaacuagaauuugcaaaugauacgaaaauagcuucacagcucggcaacugcguagaauacucuuuauaugggguuucaggacgcggcguauuucaaaauugcacagccguuggggugagacaacaacgcuuuguauaugaugcauaccaaaaccuagucggcuacuauucagacgacgguaacuauuacuguuuaagagcuugugucucaguuccuguaagcguaauauaugauaaagaaacaaaaacacacgccacccucuuuggaucuguugccugcgaacauauuaguucaacuaugucccaauacucacgauccacucgcagcauguuaaaacgacgagauucaacauaugguccucuacaaaccccaguuggauguguacuaggucuaguaaacucgucccuuuuuguugaagacuguaaacucccucuuggacaaucacucugugccuuaccagauacaccgucaacucucacucccuaa

SEQ ID NO: 2214 - RNA, 2244 nt, Artificial Sequence
  derived and/or modified CDS sequence (opt6) from MERS-CoV__ALJ54517__S1
augauacauaguguauuucuucucauguuuuuacuuacacccacagaaucauacguugaugucggacccgauuccgucaagucagcuuguaucgaaguagacauacaacaaacuuucuuugacaaaacauggccucggccuauagacguaucuaaagcagauggaauuauauauccucaaggacgaacuuauuccaacauaacaauaaccuaucaaggucuuuuucccuaccaaggugaccacggcgauauguauguuuacucagcaggacaugcaacugguaccacuccucagaaauuauuugucgccaauuauagccaagacgucaaacaauuugcaaacggauuugucguccgaauaggcgcugcagcaaauucaacuggcaccguaauuauuucucccucaacaucugcaaccauaagaaaaauauauccagcuuuuaugcuaggaucaucagugggaaauuucucugauggcaaaaugggaagguucuucaaucacacuuuaguacuuuuaccagaugguugcgguaccuuauuacgagcauuuuacugcauauuagaaccacguuccggaaaucauugcccagcaggcaacucauacacuucauucgcuacauaccacacaccggcaaccgacuguucugacggaaacuauaaucgaaaugcuucacucaauuccuucaaagaauacuuuaauuuaagaaauuguacuuucauguauacauauaauauaaccgaagaugaaauccuugaaugguuugguauuacucaaacugcucaaggaguccaucucuuuucuucacgauauguagaucuauacggaggaaacauguuucaauuugcuacacucccaguuuacgauaccauaaaauauuacucuauaauaccucauucuauaaggucaauacagucugauagaaaagcaugggcagccuucuauguuuauaaacuacaaccacuaacauuuuuauuagauuuuuccguagauggauacauacgucgagcuauugauugcggauuuaacgauuuaagccaauuacauuguucauaugaaucuuuugauguugaauccggaguauauucaguaucaucauuugaagccaaaccgucaggaucagucguagaacaagcagaaggaguagaaugugacuuuucuccacuacugucuggaacaccaccacaaguuuacaacuucaaaagacucgucuuuaccaauuguaauuauaauuuaacaaaauuacuaucucuauucuccgucaacgauuuuacuugcagccaaauauccccagcagccauagcgucuaauuguuacucuucccuuauucucgauuauuuuuccuacccccuuucaaugaaaucagaccuguccgucucuucagcaggaccaauaucacaauuuaacuacaaacaaucuuuuucaaacccaaccugccuaauuuuagccacaguaccacacaaucuaaccaccauaacaaaaccacuaaaauacagcuauauuaauaaauguucucgacuucuauccgaugaccgaacugaaguuccacaauuagucaacgcgaaccaauauucuccaugugucucaauagucccuucuacaguaugggaagacggaaacuauuaucgaaaacaauugucccccuuagaaggaggcgguuggcuaguugcaucuggcuccacuguugcuaugacagagcaauuacaaaugggcuuuggaauaacuguccaauacggcacggacacaaacucaguuuguccaaaguuagaauuugcaaaugauaccaaaauagcaucacaacuugguaacuguguagaauauagcuuauauggagucaguggacgaggagucuuccaaaacugcacagcagucggaguaaggcaacaacgauucguuuaugaugcauaccaaaaucuaguaggauacuacucagacgacggaaacuauuacugccuucgugcuuguguuucaguucccgucucaguaauauacgacaaagagaccaaaacccacgcuacauuauuuggcucuguugcaugugaacacauuucaucuaccaugucucaauauucaagaagcacaagaaguaugcuaaagagaagagacuccacauauggaccuuuacaaacaccuguggguuguguucuaggauuagugaacucgagucuauucguagaagauugcaaacuaccuuuaggacagagcuuaugugcacuuccagauacgccaucaacauuaacgccuuaa

SEQ ID NO: 2215 - RNA, 2244 nt, Artificial Sequence
  derived and/or modified CDS sequence (opt6) from MERS-CoV__ALJ54518__S1
augauacauuccguauuucuucuaauguuucucuuaacuccaacggagucuuacguugauguaggaccugauucuguuaaaucggccugcauagaagucgacauucaacaaacauucuuugauaaaaccuggccacgaccaaucgacguaucaaaagcagauggaauuauauacccacaaggacgaacuuauagcaacauuacuauaacauaucaaggacuuuuuccauaucaaggugaucauggugacauguacguauacucagcaggucaugcaacaggcacaaccccacaaaaacuauuuguagcuaauuacucucaagauguaaaacaauuugcaaacggcuuuguaguucgaauaggagccgcagccaacuccaccggaacaguaauuauaucuccuaguacaucugcuacaauuagaaaaauauaccccgcauuuaugcuuggaucaucaguaggaaauuucucugauggaaaaaugggaagauuuuucaaccauacauuaguauuacucccagauggauguggaacacuccuacgcgcauucuacugcaucuuagaaccgagauccggcaaucacuguccagcaggaaauaguuacacauccuucgcuacauaccauacgccagcaaccgacugcucagacggaaauuauaauagaaaugcuagucucaauucauucaaagaauauuuuaauuuaagaaacuguaccuuuauguacaccuauaauauuacggaggaugaaauucuugaaugguucgguauaacacaaacggcacaaggaguacaucuguuuuccagucgcuauguagaccuauacggaggaaauauguuucaguucgcuacacuucccguauacgacacuauaaaguacuauucaaucaucccacacucuauucgaucaauacaaucagauagaaaagccugggccgcauucuacguauauaaauuacaaccucucacauuccuacuagauuuuucaguagaugguuauauuagacgagcaauagacuguggauucaacgacuugagccaauuacacugcucuuaugaaucauuugaugucgaaucaggcguuuacagcguuuccucuuucgaagcuaaacccucaggcucuguaguggaacaagccgaaggagucgaaugugauuucagcccacuucucuccggaacucccccucaaguauauaauuuuaaaagauuggucuuuaccaauuguaauuauaaucuuacuaaacucuugucacuauuuucuguaaaugauuuuacaugcucucaaaucagcccugcagcaaucgcuuccaacugcuacucuucccuaaucuuagacuauuuuucuuacccucuuagcaugaaaucugaucucucgguaucuucggccggaccuauaucccaauuuaacuauaagcaaucauuuucaaacccaacaugccuuauuuuagcaaccguaccucauaacuuaacuacgauuacgaaaccacuuaaauauucuuacaucaauaaauguagcagacuuccuucagacgaucgaaccgaaguaccacaacuuguaaacgcuaaucaguauaguccaugcguaucaauaguaccaaguacgguaugggaagauggcgauuauuauaggaaacaauuaucaccuuuagaaggagguggauggcugguggcaucuggaucuacuguugccaugaccgaacaacuacaaaugggauucggcauaacaguucaauauggaacugacacuaauucagucugcccaaaacucgaauuugcaaaugacacuaaaauagccucacaacuuggaaauuguguugaauacucacuauaugguguauccggucguggugucuuucaaaauugcacagcaguaggaguaagacaacaaagauuuguauacgacgcauaucaaaaccuaguaggcuauuacucagaugacggcaauuacuacugucuucgcgcgugcgucuccguaccaguaucuguaaucuaugacaaagagacgaaaacacacgccaccuuauucgguuccguagccugugaacauauaucaucaacuaugagucaauacaguagauccacccgauccaugcucaaacgccgagauucaaccuauggcccuuuacaaacaccuguaggaugcguccuaggacucguuaauaguuccuuauuuguagaggacugcaaauuaccacucggucaaagucucugugcacuuccagauacuccaucaacccucacacccuaa

SEQ ID NO: 2216 - RNA, 2244 nt, Artificial Sequence
  derived and/or modified CDS sequence (opt6) from MERS-CoV__ALW82691__S1
augauacauucuguauuccuacuaauguuucuucuaacaccuacagaaucauacguugacgugggucccgacucaguuaaaucagcuuguauugaaguugauauacagcaaacauuuuucgacaagacauggccaagaccaauugacgugagcaaagcagauggaauaauauauccucaaggacguacauauuccaacauuacaaucacauaucaaggucuauuccccuaccaaggugaucacggagauauguacguauacucugcuggacacgcuacuggcacaaccccucaaaaacucuuuguugccaacuacucacaagacgucaaacaauuugcaaauggauucgugguacgaaucggcgccgcugcaaacaguacuggaaccguaauuauaaguccaucuaccagugccacuauccgaaaaauauacccugcuuuuaugcuagguuccucaguagguaacuuuucagauggcaaaaugggaagauucuuuaaccauacucuuguccuccucccagauggaugcggcacucuucuaagggcuuuuuauugcauccuagaaccacgaucugguaaucauugucccgcaggcaacucuuauacaaguuuugcuacuuaccauacuccugcaacugauugcuccgacgguaauuauaauagaaacgcuucacuuaauucuuuuaaagaauauuuuaauuuaagaaacugcacuuuuauguacacauacaauaucacugaagaugaaauacuagaaugguuuggaauuacucaaacagcacaaggaguucaucuauuuucaucgagauauguagaccuauacggcggaaauauguuccaguucgcuacccuccccguauacgauacaauaaaauauuauucaaucauuccacauucaauucguucaauccaaucagaccgaaaagccugggcagccuucuaugucuacaaauuacaacccuuaacuuuucuauuggauuuuucaguagauggauauauucguagagcgauagauuguggcuuuaacgaccuaucccagcuccauugcucuuaugaauccuuugauguugaaucaggagucuacaguguuagcaguuucgaagcaaaaccaucagguucuguuguagaacaagccgaaggaguagaaugugauuuuucaccguuauuaucaggcaccccaccgcaagucuauaauuuuaagcgucucguauucaccaacugcaacuacaaccuaacuaaauuacucucguuauucucugucaacgauuucacaugcucccaaaucagcccagcagcaauagcaucaaauuguuacucuucauuaauacuugauuauuuuagcuauccccuaucuaugaaauccgauuuaucuguaucaagugcuggccccauuucacaauucaauuauaaacaaaguuuuucgaacccaaccuguuuaauccucgcaacugucccccauaaccugaccacuauuacaaaaccacuaaaauacagcuauauuaauaaauguucaagacuacgaagcgacgaucgcacagagguaccacaacuuguaaaugcaaaucaauacaguccuuguguuucaaucgugccaucuacaguuugggaagacggagauuauuaucgaaaacaauuaucacccuuagaaggagguggaugguuaguggcaucuggauccacuguugccaugacggaacagcuucaaaugggcuuuggaauuacaguacaguacgguacagauaccaauucagugugccccaaacuagaauuugcaaaugauacaaaaauugcaucacaacuuggaaauugcguugaauacagccucuauggaguaaguggcagagguguuuuccagaacugcaccgcagucggcguaagacaacaaagauucguauaugacgcguaucaaaaccuaguaggauacuauucugaugacggaaacuauuauuguuuaagagcuugugucuccguaccagucuccguuauuuaugauaaagaaacaaaaacucacgcaacucuauuuggcaguguagcuugugaacacauaagcuccacuaugagccaauauucccgaucuacccgaucaaugcuaaaacgucgagacucuacuuauggcccucuacaaacccccguugguugcguucuuggucuaguaaacucuucacucuucgucgaagacugcaaacuuccccuaggacaaucucuaugcgcucuaccugauaccccuagcacauuaacgccuuaa

SEQ ID NO: 2217 - RNA, 2244 nt, Artificial Sequence
  derived and/or modified CDS sequence (opt6) from MERS-CoV__ALW82742__S1
augauucauucaguuuuucuacuaauguuucuccuaacaccuacagaaucauacguggacguuggaccagauuccguaaaaagcgccuguaucgaagucgauauacaacaaacauucuuugacaaaacauggccacggccaauagacguuucaaaagccgaugguauuauuuauccccaaggccguacuuacaguaauauuacaauuacguaucaaggccucuuuccauaccaaggggaucacggagauauguacguauauucagccggccaugcuacaggaaccacuccccaaaaacucuuuguugcaaacuacucacaagauguaaagcaauucgccaacggauuuguuguaagaauaggagcugcagcaaauucaacaggaacagugauuauuucuccauccacaucugccacaauccagaaaauuuaccccgcauucaugcuugguuccucagugggcaacuucuccgauggaaaaauggggagauucuucaaucacacauuaguauuacuaccugauggcugcggcacauuacuaagagcuuucuauuguauacuagaaccaagaucaggcaaccacuguccugcaggaaacuccuauaccucauucgcaaccuaccacaccccugcaacagacugcuccgacgguaacuacaacagaaaugcaucccuuaauucauucaaagaauauuucaauuuaagaaacugcacauuuauguacacuuacaacauuacggaagaugaaauauuagaaugguucgguaucacgcaaacagcacaagguguccaccucuuuucuucccgauauguugaucuauacgggggaaacauguuccaauucgccacuuuaccagucuaugauacuaucaaauacuauagcauuauaccccauucaauccgaucaauacaaucagaucgaaaagccugggcagcuuuuuauguauauaaacuacaaccacucacauuucuccuggauuuuucaguugacggcuauauccgcagggcaauugacuguggauucaacgaccucucacaacuacauuguucuuaugaaucauuugauguagaaucaggaguuuauucuguuucaucauuugaggcaaaaccaucuggcagcguaguagaacaagcagaaggggucgaaugugacuucucaccccuauuauccggaacaccaccucaaguauacaauuuuaaaagguuaguauuuacuaauugcaacuacaaucugacaaaacuccucucccuauuuuccgucaaugauuucacuugcucucaaauaaguccagcugcuauugcuucuaauuguuacuccucauuaauacuagauuauuuuucuuacccacuaucaaugaaaucagaccucucuguuucgucagccgguccuauaucacaauuuaauuauaaacaaucuuuuaguaacccuacauguuuaaucuuagcgacaguaccacacaacuuaacaacgauaacaaagccacucaaauacucauacauuaauaaauguucccgucuauuaucagaugauagaacugaaguaccucaacuuguuaacgcaaaucaauacucuccuuguguauccaucguaccgucuacagucugggaggauggugacuauuaccgaaaacaauuaucaccacucgaaggaggagguuggcuaguagcauccggaucaacuguagccaugacagaacaacuacaaauggguuuuggcaucacuguccaauacggaacagauaccaauucuguaugccccaaauuagaauuugccaaugauaccaaaaucgccagucaauugggaaacuguguagaauauagccucuacggugucucagggcggggaguuuuucaaaacugcacagcaguuggaguucgccaacaacgauucguauacgacgcauaucaaaacuuagucggauauuauucugaugacgguaacuauuauugucuuagagcuuguguaucaguaccagucucugucauuuaugauaaagagacuaaaacccacgccacccucuucggaucaguagccugcgaacauauaucuucuaccaugucgcaauacuccagaucaacuaggucuaugcuaaaaaggagagacucuacauauggaccucuacagacuccuguaggauguguuuuaggauuaguaaacaguucacucuuuguagaagauugcaaacuaccacugggacaaucucugugcgcucucccugacacacccucuacacuaacccccuaa

SEQ ID NO: 2218 - RNA, 2244 nt, Artificial Sequence
  derived and/or modified CDS sequence (opt6) from MERS-CoV__ALW82753__S1
augauucacucaguauuuuuacuaauguuucuacuaacuccaaccgaaucauaugucgauguuggaccugauuccguaaagucugcauguauagaaguagauauccaacaaacauucuuugacaaaacauggcccagaccuauagacguauccaaagcagacgggauaaucuauccccaagguagaacauacaguaauauaaccauuacuuaccaaggucuauuccccuaccaaggugaccauggagauauguauguauacucagcuggacaugcaacugguacuacaccacaaaaauuguucguagcaaacuacucacaagacguaaaacaauucgcaaacggcuuuguuguucgcauaggagcagcagcuaacucaacagguacaguaaucaucuccccaucaacaagcgccaccauucguaagauuuauccugcauucaugcuaggaaguuccguaggaaacuuuuccgaugguaaaaugggacgcuucuucaaucauacccuaguacuuuuaccagauggcuguggcacuuuauugagagcauuuuauuguauuuuagagccuagaucagguaaucauugcccugcaggaaauaguuacacgucuuuugccacauaccacaccccaucaacagacuguagugauggcaacuauaaccgcaaugcuagucuuaauucuuuuaaggaauauuuuaauuuaagaaacugcacauuuauguacacauauaacaucacagaagaugaaauacuagaaugguuuggaauuacucaaacagcucaaggcguucaucucuuuucuucacgauacgucgaucuauacggagguaacauguuucaauucgcaacucuuccuguuuaugauacaauaaaauacuacucaauuauaccucauucaauccgaucaauucaaucugauagaaaggcuugggcagccuuuuauguauacaaacuacaacccuuaacuuuccucuuagacuucucaguugauggauacauucgacgcgcaauugauuguggauucaacgaucuaucccaacuccauugcuccuaugaaaguuuugauguugaaagugguguauacuccgugucaaguuuugaagccaagccaucaggcucagucguagaacaagcagaggggguagaaugcgauuucaguccauuacuuucuggaacaccaccacaagucuacaauuuuaaaagacuuguuuucacaaauuguaauuacaauuuaacaaaauugcucucucuuuuuagugucaacgauuuuacauguucucaaauaucaccggcagcuauagcauccaauuguuauuccucccuaauacuagauuacuuuagcuacccacucucuaugaaaagcgaccuuucuguuucaucugcuggcccaauaucucaauuuaauuacaaacaaucauucucuaaccccacuugucucauucuagcaacagugccgcacaaucuaacaacuauaacaaaaccuuugaaauacucauacauaaacaaauguucgcgauuacuuucugaugauagaacagaaguaccucaacuuguuaaugcuaaucaauauucuccauguguaaguauaguuccaaguacagucugggaagauggagacuacuaucgaaaacaacuuuccccacuagaaggagguggcuggcuugucgccucugguucaacaguagccaugaccgaacaauuacagauggguuucgguauuacaguucaauacgguacugacacaaauuccguauguccaaaauuagaauuugcuaaugacacaaaaauagcuucucaacucggaaacugcguagaauacucgcuauacggagugucaggcagaggcguauuucaaaacuguacugcuguagguguuaggcaacaacguuuuguuuaugacgcuuaucagaauuuagucgguuacuacagugaugauggcaauuacuacuguuuaagagcaugcgucagcguuccaguaucaguaauuuaugacaaggaaacuaagacccacgcuaccuuauucgguucaguugcaugugagcacaucucaucuacgaugucacaauacucaagaucuaccagaagcaugcuaaagagaagagauuccacuuacgguccgcuucagacacccgucggauguguacuuggucuaguaaacucaucacuuuucgucgaagauugcaagcuaccacuaggccaaucauuaugugccuuaccagauacacccucaacacuaaccccuuaa

SEQ ID NO: 2219 - RNA, 2244 nt, Artificial Sequence
  derived and/or modified CDS sequence (opt6) from MERS-CoV__ALX27228__S1
augauucacuccguauuucuccuaauguuuuuacugaccccaacagaaucuuauguagauguuggaccagauucagugaaaucagcaugcauagaaguugacauacaacaaacauuuuucgacaaaaccuggccaagacccauagacguaucuaaagccgacgguauaauauauccgcagggacggaccuacucaaauauaacuaucacauaucaaggacuauuuccauaccaaggcgaucauggagacauguacgucuauucggcuggucacgcaacagguacuacaccucaaaaauuauuuguugcaaauuacucacaagacguaaaacaauuugcaaaugguuucguaguccgaauuggagcagcugccaacagcacaggaacuguuauaauuucaccauccacuucagcaacgauacggaaaaucuauccagcauucaugcuaggaagcucuguagguaacuucucugacggcaaaaugggaagauucuucaaucacacguuaguacuacuucccgauggcugugguacacuacuccgcgcauucuauugcauucucgaaccaagaucuggaaaccauugccccgcaggaaacucguacaccucuuucgcuacuuaucacacccccgccacagauugcagugacggaaauuauaauagaaaugcgucauugaacucuuuuaaagaauacuucaaccuaagaaacuguacauucauguauaccuauaauauaacagaagacgaaauacucgaaugguucggaauaacacaaaccgcacaaggaguucaucucuucagcucccguuauguugaucuuuacggcggcaauauguuucaauucgcgacauuacccguguacgauacuauuaaauacuauuccaucauaccacauuccauaagaucaauacaauccgauagaaaagccugggcagcuuuuuacgucuacaaauuacaaccacucacuuuucuacucgacuucuccguagacggauauauaagacgagcaauagauugcgguuucaaugacuuaucucaacuccauugcucuuacgaaucauucgaugucgaaucaggugucuauucugucucaaguuuugaagcaaaaccuagcgggucaguaguagaacaagccgaaggggucgaaugugacuucucuccauuacuuucagguacaccuccacaagucuauaacuucaaacgcuugguauucacaaacugcaacuauaacuuaaccaaacuacuuagccuuuucagcgucaacgauuuuacaugcagucaaauaaguccagcagccaucgcaucaaacugcuacuccucacuaauacuugauuauuuuucuuacccacuuuccaugaaaagugaccuauccguaaguucagcuggcccaauuucgcaauuuaauuacaaacaaucauucuccaacccaaccugucuaauauuagccacaguaccacacaacuuaacuacuauaaccaaaccauugaaauauucauacauaaauaaguguucccgacucuuaucagaugauagaacagaaguaccccagcuaguuaacgcaaaccaauauucaccuuguguaucuaucguaccaucaacugucuggaaagacggugauuacuaccgaaaacaauuauccccacuagaagguggaggauggcuagucgcaucaggguccaccgucgcuaugacggaacaacuucaaaugggauucggaauaacuguacaauacggaacagauacuaauucugucugucccaaacuagaauuugccaaugauacaaaaaucgcaucacaauuaggaaauugcgucgaguauuccuuguauggaguuucaggacgagguguauuucaaaauugcacagccgucgggguacgucaacagcgcuucgucuaugaugcauaucaaaaucuaguagguuauuacuccgaugacgguaauuacuacugucucagagccuguguaucaguuccaguaucugugauauacgauaaagaaacaaaaacacaugcuacauuauuugguaguguugcaugcgaacacauaagcuccacuaugucacaauauucaagaucuaccagaucgauguuaaaaagacgugauucaacuuacggaccucuacaaacaccuguaaguugcguuuuagggcuaguuaacagcucauuauucguugaagacuguaaguuaccacuaggacaaagucuaugugcccuccccgauacaccuucuacucuaacaccuuaa

SEQ ID NO: 2220 - RNA, 2244 nt, Artificial Sequence
  derived and/or modified CDS sequence (opt6) from MERS-CoV__ALX27232__S1
augauacacucuguuuuucuccuaauguuuuuacuaacaccaacugagucuuauguagauguugggcccgacuccguaaaaucugccuguauagaaguagacauucaacaaacuuucuuugauaaaaccuggccacgccccauagacgucuccaaagcagaugguauaauuuauccgcaaggaagaaccuauaguaacauaacuaucaccuaccaaggacuauuuccuuaccaaggcgaucacggagacauguacguauauuccgcaggucaugcaacaggaacuacaccccaaaaacuauucguagccaauuauucucaagacguaaaacaauucgcaaauggauucguaguccguauaggugcugcugccaauuccaccggaacugugauaauaaguccaucaaccagcgccacaauaaggaaaauauacccagcauuuaugcuugguucaagugucgguaauuucaguuauggcaaaaugggccgauuuuucaaucacacgcuaguucuauuacccgacgguugcggaacacuccuucgggcauucuacuguauauuagagccacgaucugguaaucacugcccugcaggaaacucuuacacaucauuugcuacauaccacaccccugcaacagauuguucugaugguaauuauaacagaaaugccucauuaaacaguuucaaggaauacuuuaauuuaagaaacugcacauuuauguacacauacaacauaacugaagacgaaauacucgaaugguuuggaauaacucaaacugcacagggaguacaucuauuuaguucucgauauguugaucuauauggaggcaauauguuucaauucgcaacucuaccaguuuaugauacaauuaaauacuauucaauaauaccacauucaauacgcaguauccaauccgauagaaaagcaugggcagcauuuuacguauauaagcuacaaccucuaaccuuucuacuugauuuuaguguagacggauauauaagacgggcaauagacugcggauuuaaugaucuuucccaacuacauuguuccuacgaauccuucgacguugaaucaggcguuuauucuguaagcucauuugaggcaaaaccaucaggauccguaguugaacaagcugaaggagucgaaugugauuuuucuccucuucuuagcgggacgccuccacaaguauauaacuuuaaacgcuuaguuuuuacuaauugcaacuacaaucuaaccaagcuccucucccuauucagugugaaugacuucacauguucucaaauuucaccagcagccauugcaucaaacugcuacucaucucuaauauuagacuauuuuuccuauccacucucuaugaaaucugauuuaucaguuucaucagcugguccaauaucacaguuuaauuauaaacaaucauucagcaauccuacauguuuaauucuagcaaccguaccccauaaucuuacaacuaucacaaaaccauuaaaauauucauauaucaacaaauguaguagauuacucagugacgaccgcacagaagucccacagcuaguuaaugcuaaccaauauucacccugugucucaaucguaccuucuacaguaugggaagauggggacuacuauagaaaacaauuaucaccauuggaagguggcggaugguuaguagcuagcggcucuacaguagcaaugacagaacaacugcaaaugggauucgguauaacuguacaauacggaacugauacaaauucaguuugucccaaauuggaauuugcgaaugacacaaaaaucgccucacaauuaggaaacuguguugaauacucccucuauggagucucuggaagaggcgucuuucaaaacugcacagcuguaggaguacgacaacaaagauuuguauacgaugcuuaucaaaacuuaguuggauacuauucagaugauggaaauuacuacuguuuaagagccugugucagcguuccaguaucaguaauauacgauaaagaaacaaagacacacgccacuuuauuugguaguguagcaugcgagcauaucucauccacaaugagccaauacucucgcucuacucgaucaauguuaaaacgucgugauuccacauaugguccuuuacaaacaccagucggaugcguacucggauuaguuaacucaucacuauucguagaagacuguaaacuaccucuaggacaaucacuaugcgcacuccccgacacaccaucuacuuuaacgcccuaa

SEQ ID NO: 2221 - RNA, 2244 nt, Artificial Sequence
  derived and/or modified CDS sequence (opt6) from MERS-CoV__AMQ48993__S1
augauacauuccguuuuucuucuaauguucuuauuaacaccaacugaaucauaugucgaugucggacccgauucaguaaaaucagccugcauugaagucgacauacaacaaacuuucuucgacaaaaccuggccaagaccuauagacguauccaaagcagaugggaucauauacccccaaggucgcacauauuccaauauaaccauuaccuaccaaggucuuuuuccauaccagggcgaucauggcgacauguacguauauucagccggccaugcaacaggaacuacaccucagaaacuguuuguugccaauuauucacaagacguaaagcaauuugcuaacggauucguaguuagaauaggagcugcugccaacucuacuggaacaguaauaaucucaccauccacuagcgccacaauccgaaaaauauauccagcauuuaugcucggaucaagcguagggaauuuuucugacggaaaaauggguagauucuuuaaucauacucuaguacuacuaccagaugguuguggcacauuauuacgagcuuuuuacugcauucuagagccucgcucugguaaccauugcccugccgggaacaguuauacauccuuugccacauaccauacuccugccacagauugcagcgauggaaacuacaacagaaaugcaucauuaaauucauuuaaagaauauuuuaacuuacgaaacuguaccuuuauguauaccuauaacauuacagaagaugaaauucucgaaugguuuggcaucacacaaacagcacaaggaguacaccuauucucgucacgcuauguugacuuauauggcggaaauauguuccaauuugcaacuuuaccaguauacgauacaauuaaauauuacucaaucauuccacauaguauaagauccauacaaagcgacagaaaagccugggccgcuuucuacguuuacaaacuccaaccucucaccuuucuauuagacuuuucugucgaugguuauauacgccgagcuauugauuguggcuuuaaugacuuaagucaacuucauugcucauacgaaucauuugacguagaaucggguguuuauucuguuucaaguuucgaagcuaaaccgucaggaucaguaguagagcaggcugaggguguugaaugcgauuucucuccucuccucagcggaacuccaccacaaguauauaacuucaaaaggcucguuuuuacaaacuguaacuauaaucucacuaaacuuuuaucccuauuuucaguaaaugacuuuacaugcucacaaauauccccagcugcaauugccucuaauuguuauuccucucuaauuuuagauuauuuuucuuauccauuaucuaugaaauccgacuuauccgucagcagugccggcccuauuucacaauuuaauuauaagcagagcuuuucuaacccuacaugccucauccuagcaaccguuccacacaacuuaaccacuauaaccaaaccauuaaaauauaguuauauaaacaagugcucaagacuacuauccgacgaucgcacagaagugccacaauuagugaaugcaaaucaauauucgcccuguguuucaauaguucccuccacugugugggaagacggagacuacuacaggaaacaauuaucaccacucgaagguggcggaugguuaguagcuuccgggucaauagucgcaaugacugaacaauuacaaaugggauucggcaucaccguacaauacggcaccgauaccaauaguguaugcccuaaacuggaguucgcuaaugacacaaaaauagcaucacaauuaggaaauuguguugaauacucacuauaugguguaucaggacgaggcguauuucaaaauuguacagcaguaggaguuagacaacaacgauuuguauaugaugcauaccaaaauuuaguaggcuacuauagugaugacggaaacuauuacugucuaagagccuguguuucuguacccguaucugucaucuacgacaaagaaacuaaaacucacgccacacuauuuggcucuguagcaugcgaacacauaucaucuaccaugucacaauacucccgaucgacaagaucuauguuaaaacgccgcgauaguacuuacggcccacuacaaaccccgguugguuguguacuaggucuaguaaacucaagucuauuuguagaagauuguaaacuaccucuaggacaaucucuaugugcguuaccggacacucccagcaccuugacuccauaa

SEQ ID NO: 2222 - RNA, 2244 nt, Artificial Sequence
  derived and/or modified CDS sequence (opt6) from MERS-CoV__AMW90844__S1
augauccauucaguauuuuuacuuauguuuuuacuaacaccuaccgaaucuuauguagaugucggucccgacucgguuaaaagugcuuguauagaagucgauauucagcagaccuuuuucgauaaaacauggccccguccuauagacguaucuaaggcugauggaaucaucuacccccaaggcagaaccuauucuaauauaacaauaaccuaccaaggccuuuuucccuaccagggcgaucacggugacauguacguguacuccgcaggccacgcaacuggaacuacuccacaaaaauuauuuguagcaaacuauucacaagacgugaaacaauucgcgaacggauucgucguuagaauuggugcagcagcaaacuccaccggaacuguaaucauauccccaucaacaucagccacuauucgaaaaauuuacccugcauuuaugcuaggcucauccguagguaacuucagugauggaaaaauggguagauucuuuaaccacacccuagugcuuuugccagacgguugcggaacauuacuaagagcauuuuacuguauuuuagaaccucgaucaggcaaucacuguccagccggaaauaguuauacaucuuuugcuacauaccacacccccgccaccgacugcucagaugguaauuauaauagaaacgcgagucuaaauuccuucaaagaauacuucaauuuacguaauugcacauuuauguacacuuauaacaucacagaagacgaaauuuuagaaugguucgggauuacccaaacagcucaaggaguacacuuauuuucaaguagauacguagaucuuuauggaggcaauauguuucaauuugcuacucuuccuguauaugacacuauuaaauacuacucaauaauaccacauaguauccgaucaauucaauccgaucguaaagcaugggccgcguucuacguauacaaacuccaaccacuaacuuuucuacuagacuuuucuguagacggauauauacgucgugcaauagauugugguuuuaacgaccuaucgcaacuacacuguucguaugaaucauuugacguagagagcggaguauauuccguuucaucauucgaagcaaaacccagcggaucaguaguugagcaagcagaaggugucgaaugugacuucagucccuuauugucaggaacuccuccacaagucuauaacuucaaaagacucgucuuuacuaauuguaacuauaaccucaccaaacuauuaucccuauuuucuguuaaugauuuuacuugcucacaaauaucuccagccgcaauugcaucaaauuguuauuccucauuaauacucgauuacuuuucauacccacuuucuaugaaaucagaccugucuguaucaucugcaggaccaauuagucaauuuaauuacaagcaaucuuucuccaacccuacuugcuuaauacuugcuacagugccacacaauuuaacgacaauaacaaaaccauuaaaauauucuuacaucaacaaauguucucgucuacuaagcgacgacagaaccgaagucccccagcuaguuaacgcaaaccaauauucuccaugcguaucaaucgugccuucaaccguuugggaagauggagacuauuauagaaaacaacuaagcccauuagaagguggaggauggcuaguagcauccgguaguacaguagcaaugacagaacaacuucaaaugggauuuggaauuacauuucaauauggaaccgauacaaacuccguuugccccaaauuagaauuugccaaugauaccaaaaucgcaucacaacucgggaauugcguugaguauucccuauacggagucuccggcagaggcgucuuccaaaacugcaccgcgguuggagucagacaacaacgauuuguauaugaugcauaucaaaaucuaguugguuauuacuccgaugacggaaacuauuauugucuaagagcaugcguauccgucccgguauccgugauuuaugauaaagaaacuaagacucacgccacacuuuuuggaucaguagcuugcgaacauaucucaaguacaaugucacaauauucgcguucaacuagaucaaugcuuaaaagacgcgacucaacauauggcccauuacaaaccccugucgguugcguacuaggauuggucaauucuagucucuuuguugaagacuguaaacuuccccucggacagagccuaugugcccuacccgauacuccaucaacacuuacuccauaa

SEQ ID NO: 2223 - RNA, 2244 nt, Artificial Sequence
  derived and/or modified CDS sequence (opt6) from MERS-CoV__AMW90852__S1
augauucauucuguguuuuuauuaauguuucuguuaacccccaccgaaucauauguagacguaggacccgauuccguuaagucagcauguauagaaguugauauacaacaaacauucuuugauaaaacuuggccucgaccuauugacgucucaaaagcagauggcauuauauauccucaaggucgcaccuacagcaauauaacaauaacuuaucagggacuuuucccuuaucaaggcgaccauggagacauguauguauauucugcagggcaugcuacagguacaacaccucaaaaauuauucguagccaauuacucccaggacguaaaacaauucgcuaauggcuuuguaguacguauuggagcugcagcaaacucuacaggaacaguaaucauaucaccaucaaccagcgcaacaauccgcaaaaucuauccagcauucauguuaggcuccaguguuggaaauuuuucagacggaaaaauggguagauucuuuaaccacacacucguacuucuaccagauggcugcggaaccuuacuucgagcuuucuauuguauauuagaaccaagaucuggaaaucauugcccagcaggcaauaguuacacaucauuugcuaccuaucacaccccagcaacagacugcuccgacgguaauuacaaucgaaaugcaagucuaaauaguuucaaagaauacuuuaaccuacguaauugcacguucauguauacauauaauauaacagaagaugaaauacuugaaugguuuggcauaacccaaacagcccaaggaguccaucucuuuuccucccguuacguagaucuuuauggcggaaauauguuucaauuugcuacuuugccuguauaugacacuaucaaauauuacuccauaauuccgcauucgauacgaucaauacaauccgacagaaaagcaugggcagcauucuaugucuauaaacuccaaccacuaacguuuuuauuagauuucaguguagacggcuacauuagacgagccauugacugcgguuucaaugauuuaagccaauuacacuguucuuacgaaucauuugacguagaauccggagucuauucugugucuucuuuugaagccaaaccaagcggaucagucguagaacaagcugaaggagucgaaugcgacuuuucaccucuauuaucuggaacaccaccucaaguauacaauuuuaaacgacuuguauuuacaaauugcaauuauaacuucacaaaauuguuaucucucuucucuguaaacgauuuuacaugcucucaaauuucucccgccgcaauagcaucaaacugcuauaguucucucauauuagauuacuucucauacccauuaaguaugaaaucggaucuaucuguauccucagcaggaccuauuagccaauucaacuacaaacaaucauucucgaauccaacauguuuaauacuagcaacaguaccucauaaccuaacaacaauaacaaaaccccucaaauauucauauaucaauaaauguucucgacuuuuaucagaugaucgcacagaaguaccacagcuaguuaaugccaaucaauacucaccaugcguaaguauaguaccuucaacaguaugggaagacggugacuacuaccguaaacaacucucaccucuagaagguggcggauggcugguagcgucaggaucuacuguagcaaugaccgaacaacuucaaaugggcuucggaaucacaguacaauacggcacagacacuaauucaguauguccaaaacuagaauuugcaaaugacacuaaaauugccucacaacuagggaacugcgucgaauauucauuguacggaguuucuggacgcggaguguuccaaaauuguacagcagucggagucagacaacaaagauucgucuaugacgcuuaccagaaccuuguuggcuauuauuccgacgacggcaauuacuauuguuuacgugcuuguguaucagucccaguaucuguaauauaugauaaagaaacaaaaacacaugcgacauuauuuggcucaguugcuugugaacauauuucaucaaccaugucucaauacucucgauccaccagaucuaugcuaaaacgcagagacagcacguacgguccauuacaaacaccaguugguuguguauuaggacuugucaauucgucacuguucgucgaagacugcaaacucccuuugggccaaucucuaugugcacuacccgauacccccagcacauuaacuccauaa

SEQ ID NO: 2224 - RNA, 2244 nt, Artificial Sequence
  derived and/or modified CDS sequence (opt6) from MERS-CoV__AMW90853__S1
augauacacucaguuuuucuacuaauguuucugcucacuccuacagaaucauauguagaugugggcuccgacucaguuaaaucggcuuguauagaaguugauauacaacaaacuuucuuugacaaaaccuggccucguccaauagaugucucuaaagccgauggaauaauauacccccaaggcagaacauauucaaacauuacuauuacauaccaaggacuauuuccauaucaaggagaucacggugauauguacguauauucagcuggauaugcuacagguacuacaccacaaaaacuuuucguagcaaauuacucucaagauguaaaacaguucgcaaacgguuuuguaguaagaaucggcgcagcagcaaauucaacaggaaccgucauuaucucucccaguacaucugcaacuauuagaaaaaucuaucccgccuuuaugcuaggaucuaguguaggcaacuucucagacgguaaaaugggaagauuuuucaaccauacgcuuguacuuuuaccagauggauguggaacacuacuaagagcauuuuauuguauacuagaaccacguucaggaaaccacugccccgccgguaauuccuacacuuccuucgccacauaucauacaccagcaacagauugcucagauggcaauuacaauagaaaugccuccuuaaauucuuuuaaagaauacuuuaaucuacggaauuguacauuuauguacacauacaacaucaccgaagaugaaauauuggaaugguucggaauuacucaaacagcacaaggaguucaccuauucaguucacgcuauguggaucuuuaugguggcaacauguuucaauucgcaacucuaccaguauaugacacuauuaaguacuauucaauuauaccacauucaauacgauccauccaaucagauaggaaagcaugggcugccuuuuauguauauaaacuucaaccucugacauuccucuuagauuuuucagucgauggauauauacgccgcgcaauagauugcgguuuuaaugaccuaagucaacuccacuguucuuacgaaucauuugaugucgaaucuggaguguacucaguaagcucauucgaagcaaaaccuucagguaguguaguagaacaagccgaaggaguggaaugugacuucucaccucuucuaucaggaacacccccucaaguguauaacuucaaacgauuaguuuucaccaauuguaauuacaacuuuaccaaacuauuaucauuauuuucugucaaugacuucacaugcagccaaaucaguccagcagcuauagcaucaaacugcuacuccucucucauacuugacuauuucucuuauccauuauccaugaaauccgaccucagcgucuccucagcagggcccauuucacaauuuaacuauaaacaaucauucagcaauccaacaugucuaauacuugcuacaguaccucauaaucuaaccacuauaacaaaaccccuaaaauacuccuauauaaauaaauguucacgucuucuaucagacgaccguaccgaagugccgcaauuagugaacgcuaaucaauauucaccaugugucucaauaguuccuucuacuguaugggaagauggagauuauuaccguaaacaacucaguccauuagaagguggcggaugguuaguugccagcggaucaacaguagcuaugaccgaacaacuacagaugggcuucggcauaacaguacaauacgguacagauacuaauucgguauguccuaaauuagaguucgcaaaugauacuaaaaucgcuucucaacuugggaauugcguagaauacucacuauauggagucucuggaagagguguauuucaaaacuguaccgcuguugggguacgacaacaaagauuuguauacgacgcguaucaaaaucucguugguuauuauagugacgacgguaacuauuacugucugagagcgugcguuagcguaccaguaagcguaauauaugauaaagaaacuaagacacaugcuacucuuuuugguucgguagcaugcgaacacauuucauccacuaugucacaauauucucguuccacacgauccauguuaaaaagacgagauuccacauacggcccauuacaaacuccaguuggaugcguacucgggcuaguaaauucuucacuuuuugucgaagacuguaaauuaccauuaggacaaucuuuaugugcauugcccgauaccccaucuacucuaacucccuga

SEQ ID NO: 2225 - RNA, 2244 nt, Artificial Sequence
  derived and/or modified CDS sequence (opt6) from MERS-CoV__ANC28656__S1
augauacauucaguauuucuacucauguuucuacuaaccccuaccgagaguuacguggauguaggaccugauucaguuaaauccgccuguauugaaguagacauucaacaaacuuucuucgacaaaacauggccaagacccauagauguaucuaaggcagacgguauaaucuacccucaaggaagaacauauucuaacauaacaauaacauaucaaggacucuucccguaucagggagaucauggcgauauguacguuuacucagcaggacacgccaccgguacaaccccucagaaauuauucguagcaaauuauucacaagauguaaaacaauuugcaaauggauuuguagucagaaucggagcugcagcaaacucaacaggaacaguaauaauaaguccaucaacaucugcaacgauaagaaaaaucuauccugccuuuauguuaggcuccucuguugguaacuuuuccgauggaaaaaugggacgauucuuuaaccacacucuaguucucuuaccugacggaugcggcacucuccuaagagcauuuuacuguauacuagaaccacgauccgggaaucacugcccagcggguaauucguacaccagcuucgcuacauaccacaccccagcaacagauugcucagacggaaauuacaaucgaaacgccucacuuaauucuuuuaaagaguacuucaaccuacgaaauuguacuuucauguacacauauaauauuacagaagaugaaauacuagaaugguuuggcauaacacaaacugcacaaggcguccauuuauuuuccucacguuauguugaccucuauggagguaauauguuucaauuugcaaccuuacccguauacgacacgauaaaauauuacucaauaauuccccauaguauaagaucaauacaguccgaucggaaagccugggcugcauuuuacgucuauaaacuacaaccccuaaccuuuuuacuggauuuuuccgucgauggauacauaagacgagcaaucgacugcgguuuuaaugauuuaagccaauuacauuguaguuaugagucauuugacguugagucaggcguauauaguguuucgagcuuugaggcuaaaccgucuggaucugucgucgaacaagccgaaggagucgagugugacuucucuccauuauuaucagguacacccccacaaguguauaauuucaaaagauuaguuuuuacaaacuguaauuacaaccuuaccaagcuacucucacuauuuucuguaaacgauuuuacaugcagucaaauuucuccggcagccauagcaucaaauugcuauucaucauuaauacucgacuacuucucauauccucuuucuaugaaaucggauuuauccguuagcucugcagggccaauaagccaauucaauuacaaacaaucauucucaaaccccacauguuuaauacuugcaacuguuccacauaaccuaaccaccauaacgaaaccauuaaaauacucuuauauaaauaaaugcucccgacuucugucagauggcagaacagaaguaccacaacuuguaaaugccaaccaauauucaccaugcguaucaauaguaccaucaacaguuugggaagacggagacuacuauagaaaacaacuaucaccccuagaagggggcgguugguuagucgcauccgggucaacuguagccaugacagaacaauuacaaauggguuucggaauaacaguucaauacggcacagauacuaauucgguuuguccuaaauuagaauuugcuaaugacacaaaaauagcaagucaacucgggaacugcguugaauauucuuuauacggcguaucgggaagaggaguauuucagaacuguaccgcaguuggaguacgccaacaacguuucguuuacgaugcauaucaaaacuuaguugguuacuauucugaugacgguaauuauuacugccuacgcgcauguguuucagucccagucucugucauauacgauaaagaaacuaagacacacgcuacccuauucggaucaguagcaugugaacacauaagcucuacaaugagccaauacucccgauccacucgauccaugcuaaaacgaagagauucuaccuauggaccccuucagacaccuguaggauguguuuuaggccuagucaauagcagccuuuucguagaagauuguaaauuaccacuaggacaaucgcuaugcgcucuaccggauacucccucaacccuaacucccuaa

SEQ ID NO: 2226 - RNA, 2244 nt, Artificial Sequence
  derived and/or modified CDS sequence (opt6) from MERS-CoV__ANC28678__S1
augauccacucaguauuucucuuaauguuccuucuaacaccaaccgaaucuuauguggacgucggucccgacuccgucaaauccgcaugcauagaaguagauauacaacaaacauucuucgacaaaacauggccaagaccuauagaugucucaaaggcagauggaauaauuuauccgcaaggccguacauauucuaauauaaccauuacuuaccaaggauuauuucccuaccagggugaccauggcgacauguacguauacagcgccggacacgcuacaggaaccacaccacaaaaacuauuuguugccaauuacagucaggacguaaaacaauucgcgaacggauuuguuguacgaauaggagccgcagcuaacaguacaggaacagugauaaucucaccaucaacaucagcaacaauuagaaaaaucuacccagcauucauguuaggcucaucaguaggaaauuucucugacgguaaaaugggucguuucuuuaaucacacauuaguucuuuuaccagauggauguggaacacuauugagagcauuuuauuguauauuagaaccaagauccggcaaucacugcccagcuggcaauucguacacuucuuucgccacguaccacacaccagcuacugauuguucugauggcaauuauaauaggaaugcaucauuaaacucauucaaagaauacuuuaaccuuagaaauugcacauuuauguacacuuacaacaucacagaagaugaaauacucgaaugguuuggaauaacacaaacagcacaaggaguacauuuauucucuagcagauauguagaucuuuacggcggaaacauguuucaauuugcuacacuacccguauaugauacuauaaaauauuacucaauuauaccacacucaauuuguucaauacaaucagacagaaaagccugggcagcguucuauguauauaaacuacaaccccucaccuuccuucuugacuuuagcgucgacggguacauucguagagcaauugauugcggauucaacgaccuaagccaacuacacuguucauacgaauccuucgauguagaaagcggaguauacucgguuucuucauuugaagcuaaaccuucugguuccgugguagaacaagcagaaggaguugaaugcgauuucucaccauuacuaucaggcacaccuccacaaguauauaacuucaaaagacuuguuuuuacuaacugcaacuauaauuuaaccaaauuauuaucacuuuuuagcgucaacgauuuuacauguucucaaauaucuccugcagccaucgcaucuaauugcuacaguaguuuaauucuagacuacuuuagcuauccucucaguaugaaaagugacuugaguguuuccagugccggucccauuucucaauuuaauuacaaacagagcuuuucaaauccuacuugucucauacuugcaacuguaccucacaauuuaacaacuaucaccaaaccucuaaaauacucuuauauuaauaaauguucccgauuacuaagugacggaagaaccgaaguaccccagcuagugaaugcaaaucaauauucacccugcguuuccaucguuccaucaacagucugggaagacggagacuacuaccgcaaacaacuaucucccuuagaagguggaggauggcuaguagcuuccggaucuacaguggccaugaccgaacaacuucaaauggguuucgguauaacagugcaauauggaacugacacaaacucgguauguccuaaauuggaauuugcgaaugacacaaaaauagcaucacaauuaggcaauugcguagaauauucuuuauacggaguaucaggcaggggcguuuuucaaaauugcacagcuguaggaguaagacaacagagauucgucuaugaugcuuaucaaaauuuaguagguuauuauucggacgauggaaauuauuauugccuacgagcuugcguaucugucccagucuccguaauuuaugauaaagaaacaaaaacucacgcuacccuauuuggaucuguugccugugaacauauaucaucaacaaugagucaguauucacgaucaacacguucaauguuaaaacgccgugacucgacauacgguccacuucaaacacccguaggauguguacuuggacuuguaaacucaucacuauucguagaagauugcaaacuuccucuuggacaaucgcuuugcgcacuuccagacaccccaucaacccucacaccauaa

SEQ ID NO: 2227 - RNA, 2244 nt, Artificial Sequence
  derived and/or modified CDS sequence (opt6) from MERS-CoV__AHL18090__S1
augauacauucaguauuucuauuaauguuuuuauuaacuccuaccgaaucauacgucgacguaggacuugauucagcuaaaagcgcuuguauagaagucgauauucagcaaaccuucuucgauaaaacuuggccacguccaaucgaugucucuaaagcugacggaauaauuuauccucaaggaagaacuuacagcaacauuacaauaacuuaccaaggucucuuuccauaucaaggcgaucacggagauauguauguauauucagccggucacgcaacaggaacaaccccacaaaaauuauucguugcaaauuacucacaagauguuaagcaauucgcuaacggcuuuguuguaagaauaggagccgcugcuaauaguacuggcaccguuauuauauccccuaguaccucagcuacuauuagaaaaauauacccagcauucauguuagguaguuccguaggcaauuuuuccgacggcaaaaugggaagauucuuuaaccauacacuuguacuacuaccagauggcugcggaacuuuauuacgagcuuuuuauugcauacuagaaccacguagcggcaauuacugccccgcaggaaacucauacaccaguuucgccacuuaucauacuccugcaacugauuguucugacggaaacuacaaucguaaugcaucacucaauucauuuaaagaauauuucaaucuacguaauugcacuuuuauguauacauacaacaucacagaagacgaaauauuagaaugguucggaauaacucaaacugcccaaggaguucaucucuuuucuucacgcuauguagauuuauacggcgguaauauguuucaauucgcuacacucccaguuuaugacacaauuaaauauuauaguauaauaccacauaguauacguuccauacaaucugaucguaaggcuugggcagccuuuuauguauauaaacuacaaccccuaacuuuccucuuagacuuuucuguagacgguuacauccguagagcuauagauugcggauucaaugaucuaucucaauuacacugcucauaugagucauucgauguugaaucaggaguuuauucuguuuccucuuucgaagcuaaaccuucuggauccgucguagaacaagcagaaggcguagaaugugacuuuucccccuuacucucagggacaccaccacaaguuuauaauuucaaacgccuaguuuuuacuaauuguaauuacaauuuaacgaaauugcuaagccucuucucaguaaaugacuucacauguucccaaauuaguccagcugcaauauccuccaauugcuauucaucacuaauuuuagauuauuucuccuauccccuuucaaugaaaucagaucuaucuguauccucugcugguccuauaagucaauucaacuauaaacaauccuuuuccaacccgacaugucuuauucuugcuacaguaccacauaacuugaccacuaucaccaagccgcucaaauacucuuacaucaauaaaugcaguagacugcuaucugaugauagaacagaaguaccacagcuaguuaacgcuaaccaauauucaccauguguuucgauuguaccaucaacugucugggaagacggugacuacuaucguaaacaacucuccccacucgaagggggugguuggcugguggcuucaggguccaccgucgcaaugacagagcaacuacaaaugggcuuuggaaucacaguccaauacggaacggauacuaauucaguuuguccaaaacucgaauuugccaaugauacaaaaauugcuucccaauuaggaaacuguguugaauauucauuauauggcguaucuggaagagguguauuccaaaauugcacagcuguaggugucagacaacaaagauuuguguaugaugccuaucaaaaccucguaggauauuauagcgaugacgguaauuauuauugucuacgagcuugcgugucuguuccaguaucagucauauaugacaagaaaacuaaaacccaugcuacacuauuugguucuguugccugcgaacauauuucguccaccaugucccaauacucacgaucaacacguucaacucuaaaaagaagggacuccacauauggcccucuucaaacacccguaggcugcguucuuggacuugucaauucaucccuauuuguugaagauuguaaacuaccacuaggccaaucacuaugcgcucuaccagacacgcccucuaccuuaacgccuuag

SEQ ID NO: 2228 - RNA, 2244 nt, Artificial Sequence
  derived and/or modified CDS sequence (opt6) from MERS-CoV__AHX00731__S1
augauccauucaguauuucuucuaauguuucuauuaacgccaaccgaaagcuaugucgauguuggacccgauagcguaaaauccgcuuguauagaagucgauauacaacaaaccuucuuugacaaaacauggccaaggccaauagacguaucaaaggcugacgguauaauauauccccagggaagaacauauucaaauaucacaauaacauaccagggccuguuccccuaucaaggugaucacggggacauguauguuuauucagcuggacaugcaacaggcacuacaccccaaaaauuauuuguggcaaauuauucacaagaugugaagcaauuugcaaauggauucguuguuaggauaggagcagccgcuaacucaacaggcaccgucauaauaagccccagcaccucugcuacaauaagaaaaauauacccagccuuuaugcuugguuccucgguagguaacuucucugacggcaaaaugggucgcuuuuucaaccauaccuuaguucuacuuccugauggauguggaacacuauuaagagcauucuacugcauacucgagccaaggucugggaaucauugccccgcuggaaauuccuacacaucauuugccacauaucacaccccagcaaccgacugcagcgauggaaauuacaaccgaaaugcuucccuaaauaguuuuaaagaauauuuuaaucuacggaauugcacauucauguacacuuacaacauuacggaagaugaaauacuagaaugguuuggaauuacacaaacugcucaaggcguccaucuauuuucaucuagauacgucgauuuauauggaggaaacauguuucaauuugcuacucuaccuguauacgauacaaucaaauacuacucgauuauaccacauucaauaagguccauacaauccgaccgaaaagcaugggcagcuuuuuacgucuauaaacuacagccacuaacuuuucugcuugauuuuuccguagauggauacauuagacgagcaaucgauuguggauuuaacgauuuaucucagcuucacuguucuuacgaauccuuugacguggaaucaggugucuacucagucucaaguuuugaagcaaaaccuucaggauccguugucgaacaagcagaaggggucgaaugcgauuucucaccucuacucagcgguacuccuccacaaguauacaauuucaaaagauuagucuuuacaaauuguaacuauaaccuuacaaaacuacucagucucuuuuccgucaaugauuuuaccugcucacaaauauccccagcugccaucgcaucaaacugcuacucuucccuaauauuagauuacuucucuuauccacuuucaaugaaaucagauuuaggcguuucuucagcuggaccuaucucgcaauucaauuacaaacaaucauuuucuaauccaaccuguuuaauauuagcaacaguuccacauaacuuaacaacaauaacaaaacccuuaaaauacaguuacaucaacaaaugcucaagacuccuaucugaugauagaacagaaguuccucaauuaguuaacgccaaucaauacaguccgugcguaucaauaguaccaucaacaguuugggaggauggugacuacuauagaaaacaacuuagcccucucgaagguggcggauggcucguagccucuggaucaacaguagcaaugacggaacaacuccaaauggguuucggaauuacaguacaguauggaacugacacaaacucaguauguccuaaguuagaauuugccaacgacacaaaaaucgcaucacaauugggaaauuguguagaauauucauuauacgguguaucugguagaggagucuuccaaaauuguacagcaguuggaguaaggcaacaaagauuuguuuaugaugcauaccaaaaccuaguagguuauuacucugacgauggcaauuauuacugucuaagagcuuguguauccguaccaguaucaguaauauacgauaaagaaacuaaaacucaugcaacccucuuuggaucaguagcaugcgaacauaucucaucuacaaugucacaauauucaagaucaacaaggucaauguuaaaacgaagagauaguacuuacgguccccuucaaacaccagugggauguguccuaggucuuguaaauucaucacuuuucguggaagacugcaaacuuccacucggccaaucucuaugugcacuuccagacacccccaguacccucacaccuuaa

SEQ ID NO: 2229 - RNA, 2244 nt, Artificial Sequence
  derived and/or modified CDS sequence (opt6) from MERS-CoV__AHX71946__S1
augauucauucaguauuucuacuaauguuccucuuaaccccaaccgaaucauauguagauguaggaccggauucugucaagucggcaugcauagaagucgauauccaacaaacuuucuucgacaaaaccuggccccgacccauugacgucucuaaagcugacggaauaauauacccccaaggucguacuuacuccaauaucacaaucacuuaucaaggacuuuucccuuaucaaggagaccauggagauauguauguauacucagcaggucacgcuacuggaacaacaccacaaaaacucuucguugcaaacuacucacaagauguaaaacaauuugcuaauggauucgucguuagaauuggugccgccgcaaacucuacggggacaguuauaauuaguccaucuacaucagcuacgauacgcaaaauauaccccgcuuucaugcuaggauccucagucggaaauuuuucugacggaaaaaugggucgauucuuuaaccacaccuuaguacuauuaccggacgguuguggcacauugcuacgggcguuuuacugcauauuagaaccccgaucgggaaaccauugcccagcaggaaauucucauacgaguuuugccaccuaucauaccccagcgaccgacugcuccgauggcaauuacaacaggaaugccucacuaaauagcuuuaaagaauauuuuaaccuucgcaacuguacauucauguacaccuacaacauaacagaagaugagauccuugaaugguuuggcaucacucaaacagcucaagguguucaucucuucucuucucgcuauguugauuuauauggcggaaauauguuccaauuugcaacuuuaccaguauaugauacuauaaaauauuacucaauuauaccccauagcauuagaagcauacaaucggacagaaaggcuugggcagcauuuuaugucuauaaacuacaaccguugacuuuucuacuugauuucucaguagauggauauauaaggcgagcuauagauuguggguuuaaugacuuaucacaacuucauuguuccuacgaaaguuucgaugucgaaucugguguuuauucuguaucuucauucgaagcaaaaccgucaggaucagucgucgaacaagcagaaggaguugaaugugacuuuucaccccuacuaucaggaacaccuccccaaguauacaauuuuaaaagauuaguauuuacuaacuguaauuacaaccuuacgaaguuguuaucucuauuuagugucaacgauuucacaugcucucaaauaagcccagcagcgaucgcuucgaauuguuauucuucacuaauccucgauuauuuuucauacccauuaucaaugaaaucagauuuauccguaucuagugccggaccaauaucacaauuuaauuacaaacagagcuuuucuaaccccacuugccuuauacuagcgacuguaccccauaaucuuacaacuauaacaaagccucucaaauacucauauauaaauaagugcucaagacuacuuucugaugaccgaaccgaaguuccccaauugguaaacgcaaaccaauacuccccuuguguguccaucguuccaucaacagucugggaagacggggauuacuacagaaaacaauuaucgccauuagaaggaggcggaugguugguggcaucaggaucuacaguagcuaugacggaacaauuacaaaugggcuuuggaaucaccguacaauacggaacugacacaaauuccguuugccccaaacucgaauuugcuaaugauacuaaaauagccucacaacucgguaacuguguagaauauucauuauacggcguuucuggcagaggaguauuucaaaacuguacagcuguuggaguaagacaacaaagauuuguauaugacgcuuaucaaaaucucguaggcuacuauucagaugacgguaacuacuauugcuugagagcauguguuaguguccccguaucuguuauauaugauaaagaaaccaaaacccacgcaacuuuauuugguaguguagcaugugagcauauuucaaguacaaugagccaauacagccgaucaacacgcucaaugcuaaaaagaagagacagcaccuauggucccuuacaaacaccggugggcugcgugcuaggucuagucaacuccucccucuucguagaagacugcaaauuacccuuaggucaaucacuuugugcuuuaccagauacaccuaguacacuaacuccauaa

SEQ ID NO: 2230 - RNA, 2244 nt, Artificial Sequence
  derived and/or modified CDS sequence (opt6) from MERS-CoV__AHY22545__S1
augauccacagcgucuuccuacuuauguucuuacuaacaccuacagaaucuuacguagacguuggucccgacuccguuaaaucagcuuguauagaaguagacauacaacaaacguucuuugacaaaacuuggccacguccuauagacguuaguaaagccgauggcauaaucuauccccaaggaagaaccuauagcaacauaacuauaacauaucaaggucuauuucccuaccaaggugaccacggcgacauguacguauauucugcaggucaugcuacaggaacaacuccucagaaauuauucguagcaaauuacucucaggauguaaagcaauuugcaaacggauucguaguaagaaucggagcagccgcaaacuccacuggaacaguaauaauuucaccuuccacaagugcaacuauaagaaaaauauauccagcuuucaugcucggaucuucgguaggaaauuuuuccgauggcaaaauggguagauuuuucaaccacacacuuguacuauuacccgacggcuguggaacccuacuaagagccuucuauuguauacuugaaccuagauccgguaaucacuguccagcaggaaauucauacacuuccuuugccacuuaccauaccccagcuacugacuguuccgacgguaauuauaauagaaaugcaucacuaaauaguuucaaagaauauuuuaauuuaagaaacugcacauucauguauacguauaacauaaccgaagacgaaauauuagaaugguuugguauaacucaaacugcacaggguguucaucuuuuuaguucaagauacguagaucuauauggaggaaacauguuccaauucgcuacauugcccguauacgacacuauaaaauacuacuccaucaucccucacucaauuagaucuauacaaucagaucgaaaagcaugggccgcauucuauguguacaaauuacaaccauuaaccuucuuacucgacuucuccguagacggcuacauacguagagcaauagauugcgguuucaaugaucuaagccaacuacauugcucauacgaauccuuugauguagaaucaggagucuacagcgucucaucuuuugaagcaaaaccuuccggaucaguuguugaacaagcugaaggggucgaaugugauuucuccccacuauuaaguggaacucccccucaaguauacaacuucaauagacucguauucaccaauugcaauuacaacuuaacuaaauuauuaucgcuuuucucaguaaacgacuuuaccugcucacagauauccccugcugcaauagcauccaacuguuauucaucacucauauuagacuauuuuuccuauccauuaagcaugaaaucagaccuaaguguaucaucugccgguccuauaagccaauucaauuauaaacaauccuucuccaacccuacgugccuaauauuagcaacuguaccacacaauuuaacaacuauaacuaaaccauuaaaauacucuuacauaaacaaauguucccgcuuacuuucagaugaucgaacagaaguuccacaacugguaaaugcaaaucaauauucuccauguguaucaaucguuccuucaaccguaugggaagauggcgauuacuauaggaaacaauuaucaccucuugaagguggaggaugguuaguagcaucaggcaguacagucgcaaugaccgaacaacuccaaaugggauucggaauaacuguacaauauggaacugauacaaacucaguuugccccaaacuagaauuugcuaaugauacuaaaauagcuucucaauuaggaaauuguguagaauauagcuuauaugguguuucuggaagaggaguauuccaaaacugcacagcugucggcguaagacaacaaagauuuguauaugacgcuuaucagaauuuaguaggcuauuauagcgaugacggaaauuauuauugccuucgagccugcguaucagucccuguuucaguaauauacgauaaagaaaccaaaacccaugccacacuauuugggucagucgcaugcgaacauauuucaucaacaaugucacaauauucgcguuccacuagauccaugcuuaaacgucgagauagcacuuauggcccacuacaaacgccaguaggauguguuuuaggacucguaaauucaaguuuauucguagaagauuguaaauuaccccucgggcaauccuuaugcgcgcucccagauacaccaucuacccuaacuccuuaa

SEQ ID NO: 2231 - RNA, 2244 nt, Artificial Sequence
  derived and/or modified CDS sequence (opt6) from MERS-CoV__AHY22555__S1
augauacauucagucuuucuacucauguuuuuacuuacaccuacggaauccuauguugacguuggaccugacucuguuaaaucagcuuguauagaaguugauauacaacaaacauucuuugauaaaacauggccccgccccauagacguaagcaaagcagacgguauaauauauccacaaggaagaacauacagcaauauaacgaucacguaucaaggacuuuuuccauaucaaggagaucacggcgauauguauguauauucagccggacaugcuacaggaacuacaccccaaaaacucuuugucgcuaacuauucccaagauguuaaacaauucgcuaauggguucgugguaagaaucggugcagcagcuaauagcacuggaaccguaauaaucucgccguccacuuccgcgaccauacgaaaaauauacccugccuuuaugcuuggauccuccgucggcaauuuuucagacggaaaaaugggacgauucuuuaacuauacauugguuuuacuuccagacggaugcggaacacuucuucgugcauuuuauuguauacuggaaccucgaucaggaaaucacugcccagcaggaaacuccuacacaaguuuugcaacauaucauacuccagcaacagauuguucugauggcaauuauaauagaaacgcuucgcucaauagcuuuaaagaauacuucaaucuacgaaauuguaccuuuauguauacuuauaauauaaccgaagaugaaauuuuagaaugguucggcaucacccaaacagcacaagguguccaccuuuuuagcuccagguaugucgaucuuuacgguggcaauauguuucaguuugcaaccuuaccuguauaugacacuauuaaauauuauucuaucaucccacauaguauccgcucaauucaaucugauagaaaagcaugggcgucauuuuauguauauaaacuacaaccacuaacuuucuuauuagauuuuucugucgacggcuacauccggagggcaauagauuguggauuuaaugaccuaucucaacuucacugcuccuacgaaaguuucgacguagaaucagguguuuauuccguuuccaguuucgaagcuaaaccaagugguucuguaguagaacaagccgaagguguagaaugugacuuuucuccccuacucuccgguacaccgccucaagucuauaacuucaaaagacuuguauuuacuaacugcaauuauaaccuaacaaaacuauuaucccucuucuccgucaaugacuuuaccugcucacagaucucccccgcagcaaucgcaucgaauuguuacaguuccuuaauccuagauuacuuuucguauccucuuucuaugaaauccgaccuauccguaucuucagcgggcccaauuucucaauucaauuauaaacaauccuuuuccaauccaaccugucuaauacuugcaaccguuccacauaacuuaacgacaauaacaaaaccauuaaaauauucuuacauaaacaaaugcucaagacuucugucagaugauagaacagaagucccccaauuaguaaauagcaaucaauauucgccuugcgugaguauuguaccaucaaccguaugggaagauggagacuacuauaggaaacaacuaucaccucucgaaggaggaggauggcuaguagcuucggggaguaccguagcaaugacugaacaacuccaaaugggcuuuggcauaacuguccaauauggaacagauacuaacucaguuuguccaaaacucgaauuugcaaaugacacgaaaauagcaucccaauuaggaaauugcguugaauauucucuuuauggcguuucggguagaggaguauuucaaaacugcacugcaguuggaguacgucagcaacguuucguauaugaugccuaucaaaaucucguagguuacuacucagacgacggcaauuauuauugcuuaagagcuugugucucaguaccuguuucaguaauuuacgauaaagaaacaaaaacacaugcaacacuguucgguaguguagcaugcgaacauauaaguuccacuaugucucaauacucaaggaguacaagaucaaugcucaagaggcgagauuccacuuauggcccucuacaaaccccuguaggauguguccuuggauuaguuaacucaagccuauuugucgaagacuguaaacuaccucuaggacagucacuaugcgcacuucccgauacaccaucaacauuaacccccuaa

SEQ ID NO: 2232 - RNA, 2244 nt, Artificial Sequence
  derived and/or modified CDS sequence (opt6) from MERS-CoV__AHY22565__S1
augauacacucuguauuucuauuaauguuccuuuuaacaccaacagaauccuauguugauguugguccugauucggugaaaucggcuuguaucgaagucgacauacaacaaacauucuucgauaaaacauggcccaggccaaucgaugucuccaaagcagaugggauuauuuacccucaaggcaggaccuauucgaauaucacaauuaccuaccaaggacucuuuccauaccaaggagaucacggcgauauguacguguacucagcaggccacgccacaggaacaacaccgcaaaaacuauucguagcaaauuacucccaagauguuaaacaauuugcaaauggcuucgucguacguauaggugcagccgcaaauuccacuggaacaguuauaaucucacccagcacuucugccauaauccguaaaauauauccugcauucaugcuagggucuuccguaggcaacuucucagacggaaaaaugggacgauucuuuaaucauacccuaguuuuauuaccagacgguugcgguacucuucuuagagcuuuuuauuguaucuuagaaccccgcucaggcaaccauuguccagcagguaauucauauacuucauucgcaacuuaucauaccccagccacagauuguucugauggaaacuacaaucguaacgcuaguuugaauagcuucaaagaauauuucaaucuacguaacugcacuuuuauguacacauauaauaucaccgaagacgaaauacuugaaugguucggaauaacacaaaccgcccaaggcguacauuuauuuagcucccgauauguagaccucuaugguggaaacauguuucaauucgcuacacuaccaguuuaugauacaaucaaauacuacucuauuauuccucauuccauacguucaauucaauccgauagaaaggcaugggcgucauuuuauguauauaaauuacaaccauuaaccuucuuacuagacuuuucugucgauggauauauacgacgcgcaauagacugcggauuuaaugacuuaucucaauuacacuguucauaugaaucauucgauguagaaaguggcgucuacaguguuucaaguuuugaagcaaaaccaagcgguagugucguagaacaggcagaaggaguagaaugugacuuuucaccacuacuaagugguacuccuccacagguguauaauuucaaaagacuugucuucacaaacugcaauuauaaccuaacuaaacuucuaucacucuucucagucaacgauuuuacauguucccaaaucagcccagcugcaauagcuaguaauugcuacucaaguuuaauauuagauuacuucucuuauccccuuucuaugaaaucagaucuaucuguuucaucagcaggacccauaucucaauucaacuauaagcaaaguuuuaguaauccaacaugucucauacucgccacaguuccgcauaaucuaacaaccauuacaaaaccccugaaauacucauauauaaacaaauguucacgccuauuaucagacgacagaacagaaguaccacaauuaguaaacgcgaaccaauacucaccauguguuaguauuguuccaucaacaguaugggaagacggugacuauuaucgaaaacaguuaucuccuuuagaagguggaggguggcuuguagcaucaggaucaacaguagccaugacagaacaauuacaaaugggauuugggauaacuguccaauauggaacugacaccaauagcguaugucccaaauuagaauuugcuaaugacacaaaaauugcuucucaacuuggaaauugcguagaauacucucuauauggugucucaggccggggaguauuccaaaacuguaccgcaguuggagucagacaacaaagauuuguauaugacgcuuaccaaaaucuaguaggauauuacucagacgauggaaauuauuauugcuuaagagcaugcguuaguguaccaguaaguguaaucuaugauaaagaaacaaaaacacaugcaacuuuauucggcucagucgcuugugaacauauaucuucgaccaugucacaauauucaagaucuacaagaucaaugcuaaaacgacgugacucaacuuaugguccuuuacaaacuccaguugguuguguacuaggucucguuaauucaucucuauuuguggaagauugcaaacucccauuaggacaaucuuugugugcccuuccugacacaccuucuacucuuacacccuaa

SEQ ID NO: 2233 - RNA, 2244 nt, Artificial Sequence
  derived and/or modified CDS sequence (opt6) from MERS-CoV__AJG44069__S1
augauacacagcguauuuuuacuuauguuucuauuaacaccuacagaaucuuauguugauguaggaccagauuccguuaaaucagccugcauugaagucgauauacaacaaaccuuuuucgauaaaacuuggccucgaccaauagacguuucaaaggcagauggcauuauuuauccacaagggaggacauauucuaauaucacaauaacauaucaaggacuauuuccauaucaaggagaccauggcgacauguacguguacagcgcuggucacgcaacaggcacuacgccucgaaaacuuuuuguagccaacuauucacaagaugucaaacaauuugcuaaugguuuuguaguccgaauuggugccgcagcaaauucaacaggcacugucauaauuucaccuagcacauccgcaacaauaagaaaaauauauccugcguucaugcugggcuccucugucggcaauuuuagcgacggaaaaaugggacgguuuuucaaccacaccuuaguacuguuacccgaugguuguggcacuuuguuaagagcguucuauugcauauuagaaccuagaucuggcaaucacugcccagcgggaaauucauauacaaguuuugcaacauaccacacacccgcuacggacugcucagauggaaauuauaaucgaaaugcuucauuaaauagcuuuaaagaauacuuuaacuuaagaaauuguacauucauguauacauacaauauaaccgaggacgaaauauuggaaugguuuggcauuacacaaaccgcacaagggguccaccuauucagcucaagauauguagauuuauacggaggcaacauguuccaauucgcaacccuccccguauacgacacgauuaaauauuauucaauuauaccucauuccauaaggucaauccaaucugaccguaaggcuugggcagcauucuauguuuauaaauuacaaccacuaacauuccuacuugauuuuucaguugaugguuauauccgacgugcaaucgacugugguuuuaaugaucuuucucaauuacauuguucauaugaaucauuugauguagaaucaggcguuuauucgguaaguuccuucgaagcuaaaccaucugguagcguaguagaacaagcagaagguguugaaugcgacuucuccccuuuacuuucaggaacacccccucaagucuacaacuuuaaacgacucguauuuaccaacuguaauuauaaucucaccaaacugcuaucccuauuuucaguuaacgauuuuacaugcucacaaauaagcccugcggcaauagccucaaacugcuacucaaguuuaauacuagauuauuuuuccuauccuuuaucgaugaaaucagaucuaucuguaucgucugcaggaccuauaucacaguucaacuauaaacaguccuucucuaauccaacaugucuaauccucgcaacaguaccucauaauuuaacuacuauaaccaaaccauuaaaauacucuuauauaaacaaaugcucccguuuacuaucagaugauagaacugaaguaccacaauuaguuaacgcaaaccaauauaguccaugcguaaguauaguuccuucuacaguaugggaagacggggacuacuaccguaaacaacuauccccauuagaaggcggagguuggcuaguugcaucuggcucuacaguugcuaugacagaacaacuacaaauggguuuuggcauaacgguccaguauggaacagacacaaauucaguuuguccuaaauuagaauuugcaaacgauacaaaaaucgcaucccaacucgggaauuguguagaauauuccuuauauggaguaucuggaagaggagucuuucaaaauugcacagcaguaggaguacgacaacaacgauucguuuaugacgcauaccaaaaccucguaggcuacuauucugaugauggcaacuauuauugucuacgggcauguguuucugucccaguaucagucaucuaugacaaagaaacaaagacucaugcuaccuuauucggaucuguggcaugcgaacauaucucuaguacaaugucucaauacucaagaucaacaaggucuaugcuuaaacguagagauucaacuuauggaccacuacaaaccccuguaggcuguguccucggauuaguuaauaguucuuuauuuguugaagauuguaaacuaccacuaggucaaagccuuugcgccuuacccgauacuccuucaccucuaacaccuuaa

SEQ ID NO: 2234 - RNA, 2244 nt, Artificial Sequence
  derived and/or modified CDS sequence (opt6) from MERS-CoV__AJG44080__S1
augauacacagugucuuccuuuuaauguuccuacuaacuccaaccgaaagcuauguugauguuggcccagacuccguaaaaucggccuguaucgaagucgacauucaacaaacuuucuuugacaaaacauggccacgccccauugacguaucaaaagccgaugguauaauauacccacaaggaagaacauacagcaauauaacaauuacuuaccaaggucuuuucccauaccaaggagaccauggagacauguauguuuauucagccggucaugcuacaggaaccacaccacaaaaacuauuugucgccaacuauucacaagauguaaaacaauucgcuaacggauucguaguccgcauuggagcagcugcaaacucaacugggaccguuaucauaucuccauccacaagugcaaccauacguaaaaucuauccagcauucauguuaggaaguucagucggaaacuuuucagacggaaaaaugggacgauuuuucaaccauacacucguccuacuaccagaugguuguggaacacuauuaagagcauuuuauuguauucuugaaccaagaagcggaaaccauugcccagcaggcaacaguuacaccuccuuugcaacauaccauacaccagccacagauuguucagacggaaauuauaacagaaaugccucacuuaacucuuuuaaagaauauuucaaccuaagaaauuguacauucauguacacauauaauauuacugaagacgaaauacuagaaugguuuggcauuacacaaaccgcucaaggcguccaucucuuuucaucccgcuacguagaucucuauggagggaauauguuccaauucgcuacacuaccaguauaugacaccauaaaauacuacuccaucauuccacauucuauuagaucgauaaaaucugaucgaaaagccugggccgccuuuuauguuuauaaauuacaaccauuaacuuuucuccuagauuucagugucgauggauauauccguagagcaauagacugugguuuuaacgaucucagucaacuucauuguaguuaugaaucauuugacguagaaucaggaguauacucaguauccucauucgaagcaaaacccucaggaaguguaguagaacaagcagaaggcguagaaugugauuuuucuccccuucuuucagguacacccccgcaagucuacaacuuuaaaagacucgucuucaccaacugcaauuauaauuugaccaaacuacucucuuuauucagcgugaacgauuucacaugcucucaaauaucucccgcagcuaucgcaucaaauuguuacuccucacuuaucuuagauuacuuuagcuauccguuaucaaugaaaucggauuuaucaguaagcuccgcgggaccaauaagucaauucaauuauaaacaauccuucagcaacccaacuugcuuaauucuugcuacaguuccacauaaucucacaacaauuaccaaaccauugaaauacuccuauauuaauaaauguucaagacuacuuuccgaugauagaacugaaguaccacaacucguaaaugcaaaucaauauucaccuuguguuucaauaguuccuucaacuguaugggaggacggggacuauuacagaaaacagcuaucuccauuagaaggcggaggaugguuagucgcuucaggauccacagucgcuaugacagaacaacuccagaugggauuuggaauaacuguacaauacggaacagauacuaacucaguuugcccaaaauuagaauuugcuaaugacacgaagaucgcaagccaacuaggaaauugcguagaauauagcuuauauggaguuucaggcagagguguauuccaaaacugcaccgcagucgguguacgacaacaaagauucgucuaugaugccuaucaaaaccuaguuggcuauuauucagaugacgguaauuacuacuguuuaagagccugcguaucaguuccagucucuguaauauacgacaaagaaacaaaaacccaugcuacacuauuuggaucaguugcuugcgaacauauuaguaguacuaugagccaauacucucguucuacaagauccauguuaaaacguagagauucuacauauggccccuuacagacuccaguagggugcguacuagguuuagucaauucuucacuauuuguugaggacuguaaacuccccuuaggucagagucuuugugcauuacccgacacuccaucuccccugacuccauaa

SEQ ID NO: 2235 - RNA, 2244 nt, Artificial Sequence
  derived and/or modified CDS sequence (opt6) from MERS-CoV__AJG44102__S1
augauucauuccguauuucuccuaauguucuugcucaccccaaccgaaaguuaugucgauguaggcccagacagcguuaaaucugcauguauagaaguagacauacaacaaacauucuucgacaaaaccuggccacgcccaaucgacguaagcaaagcagauggaauuaucuacccacaaggacgaacauacucuaauauaacaaucacauaccaagguuuauucccuuaccaaggagaucacggagacauguacgucuacagugcuggucacgcuacuggaacuaccccucaaaaacuauucguagccaauuacucccaagaugucaaacaauuugcaaacggauucguaguucgcauaggagccgcagcaaacuccacaggcacaguaauaauuucaccgucgaccagugcgacuauacguaaaauauacccggcauucaugcuaggcucaucaguuggaaacuucuccgacgggaaaaugggacgauuuuucaaccauacucucguucuuuuaccagaugguuguggcaccuuauuacgagcauucuauuguauacuagaaccccgauccggaaaucacuguccugcaggaaauaguuacacauccuuugcaacauaucacacuccugccacggacuguuccgacgguaacuauaacagaaacgcaucgcuaaauagcuuuaaagaauacuucaaucuaagaaacugcaccuucauguauaccuauaauauuacagaagacgaaauacucgaaugguuuggaauaacgcaaacagcacaagguguucauuuguuuucuucaagauauguagaccucuauggcggcaacauguuucaauuugcuacccucccaguauacgauacaauaaaauacuacaguauuauuccacacuccaucagauccauccaaucagaucgcaaagcaugggcggcauucuauguauauaaacuucaaccacucacuuucuuacuggauuucuccgucgacggauauaucaggagagcaaucgauuguggauuuaaugauuuaucacaauuacacugcuccuacgagagcuucgacguagaaucaggagucuauucaguuucuagcuuugaagcaaaaccaucaggcuccguaguagaacaagcagagggugucgaaugugauuucucuccucuuuugaguggcacaccaccacaggucuauaacuuuaaaagauuaguauucacuaauuguaacuacaaucuuacaaaauuacuuucuuuauucagugucaacgauuuuacaugcucucaaaucucuccugccgcaauagcauccaauuguuauagcucguuaauucuagauuacuuuucuuauccuuuaucaaugaaaucagauuuaaguguuucuucagcuggcccuauaucucaauuuaauuauaaacaaucuuucucaaauccuaccugccuaauuuuagcaaccgucucucacaauuuaacaacaauaacaaaaccacuaaaauauucuuacauaaacaaauguucaagauuacuaucagaugauagaacagaaguaccccaacuuguuaaugcaaaucaauauucgccaugcguuucaaucgucccuucuacaguuugggaagauggugauuacuauagaaaacaauuaucuccacuagaagggggaggaugguuaguagccucuggaucaacuguugcuaugacagaacaauuacagauggguuuuggaaucaccguacaauauggcacugauacaaauuccguaugucccaagcucgaauuugccaacgacaccaagauugcuucgcaguuaggcaacugcguagaauauucccucuacggaguaaguggcagaggaguauuucaaaacuguacagccguaggaguucgccaacaaagauucgucuacgacgcauaucaaaaucuaguugguuacuacucagacgacggaaauuacuauugucuaagggcauguguuucggucccuguaucuguuauauacgauaaagaaacuaagacacacgcgacacuauuuggaaguguagcuugcgaacacauaucaaguaccauaucacaauacuccagaucuacucguuccaugcuaaaaagacgagauucuacguacggaccccuacaaacuccaguagguugcguucuuggucuuguuaauucuuccuuauuuguagaagauugcaaacuuccauuaggucaaucucuuugugcuuuacccgacacacccucuacucuuaccccguaa

SEQ ID NO: 2236 - RNA, 2244 nt, Artificial Sequence
  derived and/or modified CDS sequence (opt6) from MERS-CoV__AJG44124__S1
augauccauaguguauuccuacuuauguuuuuacuaaccccuacagaaucuuacgucgauguaggucccgacuccgucaaaucugcuuguauagaaguagacauacaacaaacauuuuucgacaaaacuuggccccguccaauagauguaucaaaagcagauggaauaaucuacccccagggccguaccuauucuaauaucaccauuacauaucaagguuuauuuccuuaucaaggcgaucauggugauauguauguauacucagcaggccaugcaacaggcacaacaccucaaaaacucuucgucgccaacuacucacaagaugucaaacaauuugcaaacggauucguugugcgaauaggagcugccgcaaacucaacaggaacaguaauaauaucaccuucuacuucugcaacaauaagaaaaauauacccagccuucauguuaggcaguuccguaggcaauuuuucugauggaaaaaugggaagguucuuuaaccacacacucguacuuuuaccugaugguugcgguacucuuuuacgugccuucuauuguauacuugaaccuagaagugguaaucauuguccugcgggcaauuccuacacaucuuucgcaacguaccauacacccgcgacagacugcagugacggaaauuacaaucggaaugccucacuuaacucauuuaaagaauacuuuaaucuuaggaauugcacuuuuauguacacauauaacaucacggaagaugaaauauuagaaugguucggaauuacacaaacagcccaaggcguucaucuuuucucuucucgcuauguagaucuauauggagguaacauguuucaauucgcuacuuugccaguauaugauacaaucaaauauuacucuaucauaccccacucaauucgcagcauucaaucugaucgaaaagccugggccgcauucuaugucuauaaauuacaaccauuaaccuuccuuuuagauuuuuccgucgacggcuacauaagacgcgcaauagacugcgguuucaaugauuuaagccaacuacauugcucuuaugaaucuuucgaugucgaauccggaguuuauaguguaucaucauuugaagcuaaaccaucugguucuguaguggaacaagccgaagguguugaaugugacuucuccccuuuacuuucaggaacaccaccacaaguauacaauuuuaaacgauuaguauucacaaauuguaacuacaauuuaaccaaauuauuaucguuauuuucugucaaugauuuuaccugcucacagauauccccggcugcaauagcaucuaauuguuacucuucauuaauucuugauuacuuuuccuauccacuaucgaugaaauccgacuuguccguaucgucugcagguccaauuucucaauucaacuauaaacaaucuuucucaaacccuaccugccuaauauuagcaacaguuccacauaauuuaacaacuauuacaaaacccuuaaaguauucauauauuaauaaauguagcagacuacuaucagaugauagaacagaagucccacaacucgucaacgcuaaccaguauucaccaugugucucuaucguuccaucaaccguuugggaagacggagacuauuauagaaaacaacuuucaccccucgagggaggaggauggcuaguagccucaggaucuacgguagcuaugacugaacagcuacaaaugggcuuuggcauaacuguacaauauggaaccgauacuaauucaguauguccuaaacucgaauuugcuaacgacacuaaaauagcuucacaauuaggaaacugcguagaauauucucucuauggagucucuggccgaggugucuuccaaaacugcacugcaguaggaguccgucaacaaagauuuguuuacgaugcuuaucaaaaucuaguaggcuauuauucagacgauggaaacuauuacugcuuacgcgccuguguaucagucccaguaucagucauauacgauaaagaaaccaaaacacacgcaacauuauuuggcucaguagcaugcgaacacaucucuucuacaauguuccaauacucaagauccacaagaucaauguuaaaaagaagggauucaacauauggcccucuccaaacacccguaggauguguccucggacuuguaaacuccucacuauuuguugaagauuguaaauuaccauuaggucaaucucuuugugcauuacccgauacaccuucuacacucacaccauga

SEQ ID NO: 2237 - RNA, 2244 nt, Artificial Sequence
  derived and/or modified CDS sequence (opt6) from MERS-CoV__ALL26396__S1
augauccauucaguauuucuccuaauguuucuucuuacucccacagagucuuacguagacguugguccugauucaguaaaaagcgcauguauagaagucgacauccaacaaacauucuuugacaaaacauggccccguccaauugacguauccaaagccgacgguauaaucuauccucaaggcagaacauacagcaacauaacuaucacguaccaaggucuauucccauaccaaggagaccacggugacauguauguauauagcgcuggacaugccacgggaaccacuccucaaaaacuauuuguagcaaacuacucccaggacgucaaacaauuugcgaauggauuuguaguacguauaggugcagcagcaaauucaacaggcacuguaauaauauccccuucaacaagcgcuaccauacguaaaaucuacccugcauucaugcuuggaucaaguguaggaaacuuuagcgacggcaaaaugggaagauucuuuaaucacacacuuguacuauuaccagaugguugcggaaccuuacuucgcgcauuuuauuguauccuugaaccaagaagcggaaaucacugccccgcuggcaacucauauacuucuuuugcaacauaucacacgccagccaccgauugcucagaugguaacuauaacaggaacgcaagucucaauaguuucaaagaauacuuuaaccuaagaaauuguacguucauguacaccuacaauauaacagaagacgaaauauuagaaugguucggaauuacccaaacagcacaagguguacaucuguuuaguucucgauacguugauuuguauggaggcaacauguuccaauuugcuacuuuaccaguguaugacaccauuaaauauuauucuauuauaccucacaguauaagauccauacaaucagacagaaaagcaugggcugcauuuuacguuuacaaguuacagccacucaccuuucuauuggauuuuucgguagauggauacauucgucgagccauagauugcggauuuaaugacuuaucacaauuacauugcucauacgagagcuucgacguugaauccggaguauauagcguuaguaguuucgaagcaaaaccaucuggaucugucguagaacaagcagaaggagucgaaugcgauuuuucaccuuuauuaucugguacaccuccccaagucuacaauuucaaacgacuggucuucacaaauuguaacuauaauuuaacaaagcuacucucacuguucucuguuaaugauuuuacaugcucucaaauaucuccagcagccauagcaucaaauugcuacagcucacuaauccuagacuacuucucuuauccccuuucgaugaaaagcgaccucucaguaucguccgcaggcccuauaucacaauucaauuauaagcagucauuuucuaauccaacuugccuaauauuagcaacaguaccccauaaucuuacuacaauuacuaaaccacucaaauauucuuacaucaauaaauguucaagacuuuuaucagaugaucgaacugaaguaccacaauuagucaacgccaaccaauacucuccaugcguaucaauuguaccuucaacgguuugggaagauggagacuauuacagaaaacaacuaucacccuuggaaggcggaggaugguuaguugccucaggaucuacgguagcuaugacugaacaguuacaaaugggauuuggaauaacuguccaguacggcaccgauacgaauagcguauguccaaaacucgaauuugcaaaugauacaaaaaucgcaagucaauuagguaacuguguugaauauucacuauacggcguaagcggacgaggcguauuucaaaacuguacagcagugggaguucgucaacaacguuucguauacgaugcauaccaaaaccuagucgguuauuauagugacgacggaaacuauuacugucuacgcgccuguguuuccguuccagucucaguaauauaugauaaggaaacaaaaacucacgccacacuuuucgguucaguagcuugugaacacauaucaucuacaaugucucaauacucaagaucaacccgaaguaugcuuaaaagaagagacucuacauacggcccacuacaaacuccaguaggaugcguacugggucuuguaaauagcagccuaagcguagaagauuguaaauuaccauuaggucaaucucuaugugcacuccccgauacaccaucaacguuaacacccuaa

SEQ ID NO: 2238 - RNA, 2244 nt, Artificial Sequence
  derived and/or modified CDS sequence (opt6) from MERS-CoV__ALS20350__S1
augauucauuccguauuccuucucauguuccuuuuaacaccaacagaaagcuauguugacgucgguccagauagcgcaaaaucagcuuguauugaagucgacauccaacaaacuuucuuugacaaaacauggccaagacccaucgacguuuccaaagcagacggaauaauuuauccacaaggcagaaccuacagcaauauuacaauaacauaucagggccuauuuccauaccaaggagaccacggcgauauguacguauauuccgcuggacaugcuacagggacaacuccccaaaaguuauuugucgccaacuacagucaagacguaaaacaauucgcaaacggauucguagucagaauuggagcagccgcaaacaguaccggaacaguuauaaucucuccaucaacauccgccacuauaagaaaaauuuaccccgcauucaugcuagggagcucuguagguaauuuuucagauggcaaaaugggaagauucuuuaaucauacccuaguccuuuugccggauggguguggcacacuauuacgagcauuuuauuguauacuagaaccgagaucaggcaacuauugcccagcaggaaacucauacacaucuuuugccacauaucauacuccagccacagauugcagcgacggaaauuauaauagaaaugcauccuuaaacucauuuaaagaguauuucaacuuacgaaacugcacauucauguacacuuacaacauuacagaagaugaaauacuugaaugguuuggaauaacucaaacagcacaagguguucauuuauuuuccucacgcuauguagaucucuauggaggcaacauguuucaauuugccacccuccccgucuaugauacaauaaaauauuauucuauaaucccacauucaauuagaucaauccaauccgauagaaaagcaugggcagcauuuuacguuuauaaauuacaaccacuuacauuuuuacucgauuuuucaguagacggauauauaagacgagcaauagacugcgguuuuaacgaucuuucucaacuucauuguaguuacgaaucauucgauguggaaaguggaguuuauucaguauccucuuuugaagcaaaaccuagcggcucuguaguagaacaagcagaaggaguagaaugugauuucucaccccuucuuucaggaacacccccgcaaguauauaauuucaaaagacuuguauuuaccaauuguaacuauaauuuaacaaaacuccuaucccuauuuuccguaaaugauuucacauguucucaaauaucacccgccgcuaucgcaaguaauugcuacucuucucuuauucuagauuauuucuccuaucccuuaucuaugaaaucagaccuuucaguaagcagugcaggacccauaucacaauuuaauuauaagcaauccuucucaaacccaacuugucuaauauuagcaaccguaccacacaacuugacaacaauuacaaaaccccuaaaauacaguuauauuaacaaauguagccgcuuacuaagugacgauagaacagaggucccacaauuagucaacgccaaucaauauucaccuuguguaaguauaguacccuccacagucugggaagauggugacuauuaucguaaacaacuaucacccuuagagggcggcgguuggcucguagcaaguggaaguacuguagcaaugacagaacaacuucaaaugggauucgguaucaccguucaauauggaacagacacaaauucaguaugcccaaaacuagaguucgccaaugacacaaaaauagcuucacaacugggcaauugcguugaauauucguuauaugguguauccggaagaggcguauuucaaaacugcacugcaguaggaguaaggcaacaaagauuuguauacgacgcauaccaaaaucuuguaggauauuauucagacgauggaaacuacuauugucucagagccugcguuaccguuccagucuccguaauauaugacaaagaaacaaaaacacaugcaacucuauucggcucuguagcuugcgaacacauuucaucaacaaugucacaauauucacgcucuacaagaaguaugcucaaacgaagagauaguacguacggaccucuccaaaccccaguaggcugcguacugggacuuguuaacucaucacuauucgucgaagauuguaaauuaccacuuggucaaucccuaugcgccuuaccugauacaccuuccacacuaacucccuaa

SEQ ID NO: 2239 - RNA, 2244 nt, Artificial Sequence
  derived and/or modified CDS sequence (opt6) from MERS-CoV__ALT66880__S1
augauacauucuguauuucuacuuauguuucuuuuaaccccaaccgaaucauauguagacguaggucccgauucugucaaaucugccuguauagaaguagacauacaacagacuuucuucgauaagaccuggccccgucccauagacguaucaaaggcagaugguauaaucuauccacaaggccguacuuauaguaauauaacgauuacuuaccaaggucuauuccccuaucaaggagaucauggugacauguacguauauagugccggucaugcgacaggcaccacaccacaaaaauuauuuguagcgaacuacagccaagauguaaaacaauuugccaaugguuuugucguaaggaucggagcagcagcuaacucaacaggaacaguaauaauuucaccaucaacuucugcaacuauaagaaaaauuuaucccgcguuuauguuaggaucuaguguaggcaauuuuucagauggaaaaaugggucgauuuuucaaccauacacuuguacuacuuccugauggaugcggaacucuccuccgcgcuuucuacugcauuuuagaaccaaggagcggaaaucauugcccggcuggcaacucauacacauccuuugcaacauaucauacuccugccacugauugcuccgacggaaacuauaaucgcaaugcaucauuaaacaguuuuaaagaauacuuuaauuuaagaaauuguacguucauguacacuuauaauauuacugaagaugaaauacuagaaugguuuggaauuacacaaacggcacaagggguacaccuauuuucaucuagauauguagaucuauacggcggcaacauguuccaauucgcuacccuacccguauacgacacaauaaaauauuauaguauaaucccacacuccauaagauccauccaaucagacaggaaagcaugggcagcauuuuauguuuacaaauuacaaccacuuacauuccucuuggauuuuucaguugaugguuauauccgacgagcaauagauuguggauucaaugaccuuucccaacuccacugcucuuaugaaucguucgauguugaaucaggcgucuauucgguuuccucauuugaagcuaaacccuccgguaguguuguagaacaagcagaaggaguggaaugcgacuucucuccccuccuaagcgguaccccaccgcagguuuacaacuucaagcgauugguuuucacaaauuguaauuacaaucucacaaaacuucucucacuauuuuccgucaacgacuuuacauguucucagauuagcccugcagcuauagcaaguaacugcuacucaucauuaauauuagauuacuuuagcuacccccuuucgaugaaaucugacuuaucagucucuuccgcuggaccaauaucacaguucaauuauaagcaaucauuuucaaaucccacauguuuaaucuuagccacgguaccccauaacuuaacaacaaucacaaaaccucuaaaauacagcuauauaaauaaaugcagucgucuacuuagugaugauagaacugaaguaccacaauuaguaaaugcaaaccaguacagucccuguguaucaaucguuccaucuacaguaugggaagauggcgacuauuaccgaaaacaacucucacccuuagagggaggaggcugguuaguugcuagcggaucuaccguagcuaugacagaacaauuacaaaugggauuuggaauuaccguacaauacgguaccgacacuaacucaguuugcccaaaacuagaauuugcaaaugauacuaaaaucgcaucacaacucggaaauugcguugaauacucauuauacggagucucagguaggggaguauuccaaaacuguacggcaguaggaguucgccaacaacgauuuguuuaugacgcauaucaaaacuugguaggauauuauagcgacgacgguaauuacuacugccuccgagcaugcgucucggucccaguaucuguuaucuacgauaaagaaacaaaaacacaugcuacacuauucggcucugucgccugcgaacacaucucuucuacuaugagucaauacucaagaucaacacguucaauguuaaaaagacgagacucaacauauggcccuuuacaaacgccuguuggauguguccuaggucuaguuaauucaagucuauuuguagaagauugcaagcuaccacucggacaaucauuaugugcacugcccgacacuccaucuacccuuacacccuaa

SEQ ID NO: 2240 - RNA, 2244 nt, Artificial Sequence
  derived and/or modified CDS sequence (opt6) from MERS-CoV__ALA49341__S1
augauccauucaguuuuucuccuuauguuuuuacuuacacccaccgaaucauacguugacguaggaccagauucaguaaaaucagccuguauagaaguagacauucaacaaacauuuuucgauaaaacuuggccaagacccauagauguguccaaggcugauggaauuauauacccccaaggucgaacauauuccaauauaacaauaacauaccaaggacucuucccuuaccaaggugaucauggagacauguauguauacucggcaggccacgcgacuggcacuaccuuacaaaaauuauucguugcuaauuauucucaagauguuaaacaauuugcuaauggauuuguuguucgcauuggagccgcugcaaauucaaccggaacuguaauuauuucuccuaguacaucugcuaccauacgaaaaaucuacccugcauuuaugcuagguaguuccguuggaaacuuuuccgauggcaaaaugggaagauucuuuaaucauacucuuguucuccuacccgaugguugcggaacauuauuacgagcuuuuuacugcauauuagaaccuagaucuggaaaucauuguccugcaggaaacuccuauacauccuuugcaacuuaccacaccccagccacugacugcucugaugguaauuacaaccgaaaugcuucauuaaacaguuucaaagaauacuuuaaccugagaaauugcacuuuuauguauacauauaauauaacugaagaugaaauauuggaaugguuugguauaacccaaacagcacaaggaguccauuuauuuuccuccagauaugucgaucuauacggaggcaauauguuccaauucgcaacucuuccaguauaugauacgauaaaauacuacucuaucaucccucauuccauacgcucaauucaaagugaucguaaagccugggcggcauuuuacgucuauaaacuacaaccucuuacuuuucuacucgacuucuccguagauggcuauauccgacgagcaauagauugcggauucaaugacuuaucacaauuacacugcucauaugaaucauucgacguagaaucagggguauacucuguaucaucguuugaagcaaaaccguccggauccgucgucgaacaagcagaaggaguugaaugcgacuucucuccacuguuaucugggacaccaccccaagucuauaauuuuaaacgacuugucuuuaccaauugcaauuacaaccuuacuaaacuacuaucucuguuuaguguaaacgauuuuaucuguucacagauaucuccugcugcaaucgcuucaaauugcuauaguucacuuauauuagauuacuuuucauauccacuuuccaugaaaagcgacuuaucaguuucauccgcuggcccaauaucccaauucaacuacaaacaaucauucucaaauccaacaugcuuaauucuagcaacagucccucauaaccuaacaacuauuacuaaaccacuaaaauacucuuauauuaacaaguguuccagacuuuuaucagaugaucguacagaaguaccccaacucguaaacgcuaaucaauacucuccaugcguuucuauaguccccucuacaguaugggaagacggcgauuauuaucgcaaacaacuaagcccucuugagggaggcggaugguuagucgcaagcgguucaacaguagcgaugacagaacaacuccaaaugggauuuggaauaaccguacaauauggaacagauacaaauucuguuuguccuaaacuagaauuugcaaaugacacaaaaauagcaucccaacucggaaacugcgucgaauauucacuuuacgguguaucuggacgcggaguauuucaaaacuguaccgcaguuggcguucgacagcaaagguucguauaugaugcuuaccaaaaucugguaggauacuauucagacgauggaaacuauuacuguuuacgagcauguguauccguaccaguaucagucaucuaugauaaagaaaccaaaacacacgcuacacuauuuggaaguguagcaugcgaacacaucucaucuacaaugucgcaguacucacgauccacaagaucaaugcucaaacguagagauucuaccuauggaccucuacaaacccccgucggauguguuuuaggucuuguuaauuccucacuauuuguagaagauuguaaacuaccauugggucaaucccuaugugcacuaccagauacaccgucuaccuuaaccccuuaa

SEQ ID NO: 2241 - RNA, 2244 nt, Artificial Sequence
  derived and/or modified CDS sequence (opt6) from MERS-CoV__ALA49352__S1
augauucauuccguauuucuccucauguuuuuauuaacucccacagaaaguuauguagacguaggucccgacucaguaaaaucagcuugcaucgaaguagacauacaacaaacuuucuucgacaaaacuuggccccgaccuauagacgucuccaaagcagacggcauaauauauccccaaggacgaacauacucuaacauuaccaucacauaccaaggcuuauuuccauaucagggcgaccacggagauauguacguuuacucugcgggacaugcuacugguacuacaccccagaaacuguuuguugcaaacuauucgcaagacgucaaacaauuugcaaaugguuuugucguaaggaucggugcugccgcaaacucuacaggaacgguaauaaucucaccaaguacaucagcaacuauucgaaaaaucuacccagcauuuaugcuaggaucgucaguaggaaauuuuuccgacggaaaaaugggccgauuuuucaaccacacuuuaguacuacuaccugauggcugcggcacacuccucagagcauucuauuguauucucgaaccucguucaggcaaccacuguccugccggaaauaguuacacaucguucgcuacguauuacacuccugccacagauuguucagacgguaauuauaaccgaaaugcuagccucaauuccuucaaagaauauuucaacuuaagaaauuguacguuuauguacaccuacaauauuacagaagacgaaauuuuagaaugguuuggcauaacacaaacagcacaaggcguacaccuuuuuagcucacgcuacguagaucuauacggcggcaacauguuucaauucgcaacucuuccuguuuaugauacaauuaaauauuauuccauaauaccucauuccauacgaucgauccaauccgauagaaaggcuugggcagcauuuuacgucuauaaacugcaaccacuaacauucuuauuagacuucucaguagauggauauauacgccgagcaauagauugcgguuucaaugaucuaucccaacuacacugcucauacgaaucauucgacguagaauccgguguauacagugucagcucauuugaggcaaaacccaguggaucgguagucgaacaagcggagggagucgaaugcgacuuuucaccauuacuuucuggaacaccaccacaaguauauaauuucaaaagauuaguauucacaaauugcaauuauaaucuaaccaaacuucuaucauuauuuuccgucaacgauuucacaugcucccaaaucuccccagcugcaaucgcaaguaacuguuauucaagucuaauacuagauuacuuuaguuacccuuuaucaaugaaaucggacuuaucaguaucuucagccgggccaauaucccaguucaauuauaaacaaucauucucaaauccaacuuguuuaauucuagcuacgguuccccauaaucucacaaccauaacaaaaccacucaaauacucuuauauaaauaaaugcucacggcucuuauccgacgauagaacagaaguaccucaacucguaaaugcuaaccaguacucuccauguguaucuauaguacccucaacuguaugggaggacggugauuacuacagaaaacaacuuuccccacucgaagguggcggauggcucguagccagcggaucuacuguagccaugacagagcaauuacaaaugggcuuuggaauaaccguucaauauggcacagauacaaauucaguauguccuaaauuagaguucgcaaacgauacaaaaauugccucccaguuggguaacugcguagaauacucuuuguacggaguaucaggacguggcguuuuucaaaacuguaccgccguaggcguacgacaacagcgauucguuuacgaugcauaucaaaaccuaguagguuacuauucagaugauggaaauuacuauuguuuaagagcuuguguaucugucccagucucuguuaucuacgacaaagaaacuaaaacacacgcuacacucuuugguucaguugccugcgaacauauaaguuccaccaugucgcaauauucuagauccaccagaucuaugcuaaaaaggcgugacucuacuuacggaccauuacaaaccccaguuggcuguguuuuaggacugguaaauuccucacucuuugucgaagauuguaagcuaccgcucggacaaucacuaugugccuuaccagauaccccaagcacguuaacaccuuaa

SEQ ID NO: 2242 - RNA, 2244 nt, Artificial Sequence
  derived and/or modified CDS sequence (opt6) from MERS-CoV__ALA49363__S1
augauacauuccguguuucuauuaauguuucuccuuacaccaacagaaucguacguugaugucgggccagacaguguaaaaucggccuguauugaaguugauauucaacaaacuuucuuugacaaaaccuggccccgaccuauagauguaagcaaagcagacgguauaauauauccucaaggucgaaccuauuccaauauaaccauaacguaucagggacucuuuccuuaucaaggagaucacggugauauguauguuuauucagccggacacgcaacagguaccacuccacaaaaauuauuuguugcuaauuacagucaggacguaaagcaauuugcgaacggcuuuguuguuagaauuggagcugcagcaaacucaacaggcacaguaauaauaucucccucgaccucugcaaccauaagaaaaaucuauccggcauuuaugcucggcucaucagucggaaauuuuucugacgguaagaugggaagauucuuuaaccauacacuuguacuacuaccagaugguugugguacauuauugagagcauucuauugcauccuugaacccagauccgguaaccacugcccagccggaaacuccuacacaucauuugcuacauaucauaccccugcaacagauuguuccgaugguaauuauaacagaaaugcuucucuuaacucauuuaaagaguauuuuaaucuccgaaacugcaccuucauguacacauauaauauaacagaagacgaaauucucgaaugguuuggaaucacacaaacagcgcaaggcguacaccucuuuucaucaagauaugucgacuuauauggagggaauauguuucaauuugcaacuuuuccaguauaugacaccauuaaauauuauucaauaauaccucacuccauucgcagcauucaaagcgauagaaaagcaugggccgcauucuauguauauaaauuacaaccacuaacauuucuucuugauuucuccguagauggguauauucguagagcaauagauuguggauuuaacgacuuaucccaacuucauuguagcuaugaaucauuugacguagaaaguggcguuuauaguguaucauccuuugaagcgaaaccaagcgguaguguuguugaacaagcagaaggaguugagugcgauuuuucaccacuuuuaucagguacacccccacaagucuacaauuucaaaagguuagucuuuacuaacuguaauuauaauuuaacuaaauuacuuucacuuuuuaguguuaacgauuuuacgugcucacaaauuucuccagcagcuauugcaucaaauugcuacagcucacuaauccuugauuacuuuagcuauccuuuauccaugaaaucugaccucagcguuuccucggcugggccuauaagucaauucaacuauaaacaaucauucaguaaucccacaugucuaaucuuagcaacagucccucauaaucuuacaacaauaacaaaaccccucaaauacucauacauuaauaaauguucucgucuucuaucagaugaucgaacagaaguaccucagcuaguuaacgcaaaucaauacucaccaugcguaucaauaguccccucuacggucugggaggacggugacuauuauagaaaacaauuaucaccauuagaaggagguggauggcuaguagcaucuggaucuacuguagcaaugacagaacaauuacaaaugggcuucggaauaacaguacaauacggaacugacacuaauaguguuugcccaaaauuagaauuugcaaacgacacaaagaucgcgagucaauuagguaauuguguagaauacucccuguauggagucucaggacguggaguauuucaaaauugcacagcaguaggaguuagacaacaacgguucguauacgaugcauaccaaaaucuaguaggauacuauucugaugaugguaacuauuauugccuucgugcaugcgucucuguaccaguaucaguaauuuacgauaaagaaacaaaaacacaugcaacauuauucggaucuguagcaugugaacauaucagcaguacaaugagccaauauucucgcucuacccgauccaugcuaaaacgaagagauuccacuuauggcccucuacaaacacccguaggauguguccuaggucuaguuaacucuucacuauuuguagaggauuguaaacuaccccucggacaaagccuaugugccuugcccgacacaccuuccacacuaacccccuag

SEQ ID NO: 2243 - RNA, 2244 nt, Artificial Sequence
  derived and/or modified CDS sequence (opt6) from MERS-CoV__ALA49374__S1
augauacacucugucuuccucuuaauguuucuacucaccccuacagaaaguuacguagacguggggccugacucaguuaaaucagcuuguauagaaguugauauccaacaaacauucuuugacaaaacuuggccucgaccaauugaugucagcaaagccgacggaauaaucuacccucaaggaagaaccuauucgaauauuacuauaacauaccaaggucuuuuuccauaccaaggagaucauggcgauauguacguauacucagcaggacaugcaacugguacaacuccacaaaaacucuuuguugccaauuauagucaagauguuaaacaauucgccaacgguuucguaguccgcauuggagcugcggcaaacucuacagguacaguaauaauuucaccaucuacuucugcaacaaucaggaaaauauauccagccuucauguuagguucuucaguaggaaauuuuagcgauggaaaaaugggccgguuuuucaaucauacccuuguacuuuuaccagauggaugcggaacguuacuaagagcauuuuauuguauccucgaaccuagaucuggaaaccauuguccugcugguaauucuuauacaucuuuugcuacauaucacacucccgcaacugacugcuccgacggaaacuacaacaggaaugcaucauuaaacuccuuuaaagaauauuucaacuuacgaaacugcacauuuauguauaccuauaauaucaccgaagaugaaaucuuagaaugguucggaaucacacaaacagcacaaggaguccacuuauuuagcucuagauauguugacuuauacggaggcaauauguuucaauuugccacuuuaccaguuuaugacacuauaaaauauuauucaaucaucccacauucuauucgaucaauacagucagauagaaaagcaugggccgcuuuuuauguuuacaaacuccaaccacucacauucuuauuagauuuuuccguagauggauauauucgacgagcgauagauuguggauuuaaugacuuaucccaacuacauugcucauacgaauccuucgauguagaaucagguguuuauucuguguccucuuuugaagcaaaaccuaguggaucaguuguagaacaagcagaagguguugaaugcgauuuuucgccacuauuaucaggcacaccgccucaaguuuacaacuucaaaagauuaguauuuacuaauugcaacuacaacuuuacaaaacuucucagucuauucagcguaaacgacuucacauguucacaaaucucgccagcagcaauugcaaguaauuguuauuccucacucauacuggauuauuuuagcuacccacuuucaaugaaaagcgaccuaagcguaaguucagccggaccaaucucgcaguuuaacuauaaacaaaguuuuucuaauccuacaugcuuaauacucgcaacaguuccacacaaucuuacaacaauaacaaaaccucuaaaauauaguuauauuaacaaaugcucgcgauugcucagcgacgaucgaacagaagugccccaacuuguaaaugcaaaccaauauaguccaugugucucaauaguaccuucaacaguaugggaagacggcgacuacuacagaaaacaacuuagcccccuagaagggggagggugguuagucgcuucgggaucuacuguugcaaugaccgaacaacuacaaaugggcuucggcauuacgguccaauacggaacugacaccaauuccguuuguccuaaauuagaauuugcaaacgauaccaaaauugccucacaauuaggaaauugugucgaauacaguuuauauggugucuccggcagaggaguauuccaaaauuguacagcggucggaguaagacagcaacgcuuuguuuacgaugcauaccaaaaccuaguuggauauuauagugaugacggaaacuacuacugucuuagagcauguguuagcgucccuguaagcguaauauacgauaaggaaacaaaaacacaugcuacauuauucgggagugucgcgugcgaacauauaucuucgacuaugagucaauauaguagaucuacaagaucgaugcuaaaaagaagagauaguacauacggcccccuacaaacaccuguuggauguguauuaggacucguaaacucuucacuauucguagaagauuguaaacuaccacuugggcaaucauugugugcauuaccugauacuccuucgacgcucacgccuuga

SEQ ID NO: 2244 - RNA, 2244 nt, Artificial Sequence
  derived and/or modified CDS sequence (opt6) from MERS-CoV__ALA49396__S1
augauccauuccgucuuucucuuaauguuucucuuaacccccacagaaucuuauguagacguaggacccgacuccgucaaauccgcaugcauugaaguagacauacaacaaacuuucuuugacaaaaccuggccucgaccgauagacguaucaaaagcugauggcauaauuuauccucaggguaggacauauucaaauaucaccauaaccuaucagggauuauuuccauaccaaggagaccauggagacauguacguauauagugcagggcacgccacagguaccaccccacaaaaauuauuuguagccaauuacucacaagauguaaaacaauuugcaaauggcuuuguugucagaauuggugccgcagccaacucuacaggaacugucaucauaagcccuucuacuucugcaacaauuagaaaaauauauccugcuuuuauguuagguucuuccguaggcaacuucucagaugguaaaaugggacguuucuuuaaucauacgcuugucuuauuaccugauggaugcggaacacuacuccgggcuuucuauugcauccuagaaccaagaagcggaaaucacuguccagcugguaauucuuauacuucauuugccacuuaucacacuccagcaacugauuguucagacggcaauuauaaucgaaaugccucacuuaauagcuucaaagaauacuucaaucuccgaaacugcacauuuauguacacauauaauauaacugaagacgaaauucuagaaugguucggaauaacgcaaacagcacaaggcguucauuuauucucaucucguuacguggaccuuuauggagguaacauguuucaauuugccacacuccccguuuacgacaccauaaaauauuauagcauaauaccucacucuauucgaucaauacaaucagaucguaaagcgugggccgcauucuaugucuauaaacuccaaccccuaacuuuucugcuagauuuuucaguagacgguuacauccgcagagcuaucgauugcggauucaacgaccuaagucagcuucauuguucauaugaaucuuuugauguagaaucaggaguuuacagcguuucaaguuuugaagccaaaccuucagguucaguagucgaacaagccgaaggaguagaaugugacuucaguccccuucucaguggcacuccaccccaaguuuauaauuuuaaaagacucgucuuuaccaauugcaauuacaacuugacaaaauuacuuuccuuauuuucuguaaacgacuucacgugcucacaaauaucaccagcagcuaucgcaucaaauuguuacaguucuuuaauucucgauuacuucucuuauccauuaaguaugaaaucagacuuaucagucaguucagcaggaccgauaagucaauucaauuauaaacagucaucaucuaaccccacaugccuaauauuagcaaccguuccgcauaaccuaaccacaaucacaaagccauugaaauauagcuauauaaauaaaugcucuagauuacuuucagaugaucgaaccgaaguuccacaacucgucaacgcuaaucaguauucacccugcguuucaauagucccaucuacaguuugggaagacggggauuacuacaggaaacaacuuucaccacuagaaggagguggauggcucguagcgucagguagcacuguugcuaugaccgaacaauuacaaaugggcuuugguauaacuguacaauacggcacugacacuaauucaguaugccccaaacuggaauuugcgaacgauacuaaaauagcaucucaacuagguaacuguguagaauauuccuuauacggcguaagcgggcgcggaguauuucaaaacuguacagcagucgguguuagacaacaacgauucgucuacgacgcauaccaaaauuuaguaggauauuauucugacgaugguaacuauuacuguuuaagagccugcguguccguacccgucucagucauauaugauaaagaaacaaaaacucaugcaacucucuuuggaucaguagcaugugaacacauaucaagcaccaugagucaauauucucguucaaccagaucaaugcuuaaaagaagagauaguaccuauggcccacuccaaaccccuguaggauguguacugggucuaguaaauucuucacuauucguagaagauugcaaacucccauuaggucaaaguuuaugugcacuuccagacacccccucgacccuaacaccauaa

SEQ ID NO: 2245 - RNA, 2244 nt, Artificial Sequence
  derived and/or modified CDS sequence (opt6) from MERS-CoV__ALA49451__S1
augauucauucugucuuuuuauugauguucuuacuuacaccaacugaaagcuacguugacgucggucccgacucaguuaaauccgcuuguauagaagucgacauacaacaaaccuucuuugacaaaacauggccacgaccuauugacguaaguaaagcugauggaauaauauacccacaaggcaggaccuauuccaauauaaccauaacauaccaaggcuuauucccauaucaaggagaccauggagauauguauguuuacucugcuggacaugcaaccggcaccacaccucaaaaacucuucgucgcuaacuauagccaagauguuaaacaauucgcaaauggauuuguaguacguauuggugcagccgcuaauucaacaggaacuguaaucauuuccccuagcacaucagcaacaaucagaaaaaucuaccccgcauucauguuaggaagcuccgucggcaacuucucugauggaaaaaugggaagauucuuuaaucauacucucguacuauuaccagauggauguggcacacuacuucgagcauucuauugcauccuagaaccuagaucaggaaaucauuguccagcuggaaacucguacaccagcuuugcuacauaccacacaccagcaacagacugcucagacggcaacuauaaucguaacgcaucauugaauaguuuuaaagaauacuucaaucuuagaaauugcacauuuauguacacuuauaauauuaccgaagaugaaauacuugaaugguuugguauuacccagacugcacaaggaguacaccuauuuucaucacgauacguugaccuauacggagguaauauguuucaauuugcgacauuaccagucuacgauacaauuaaauauuauucuauuauuccucauucuauaagaagcauccaaagugaucguaaagcaugggcagcauuuuauguauacaaacuccaaccccuaacauuccucuuagauuuuucaguugacgguuauaucaggagagcaauagauugugguuuuaaugaucugagccaacuacacuguagcuaugaaaguuucgacguagaaucuggaguauauucaguauccagcuuugaggccaaaccuagcggaagcguaguugaacaagcugaaggaguagagugugauuucucuccacuacuaucaggcacaccuccucaaguuuacaacuucaaacggcuagucuuuacuaauugcaacuauaaccuaaccaaacuucucucauuauuuuccgucaacgauuuuacauguucccaaauuuccccugcugccauugccuccaacuguuauagcucucucauccuagauuauuuuagcuauccccuaucaaugaaaucugauuuaucuguuucaucagccggaccuauuagccaauucaacuauaaacaaucuuucucuaauccuacaugucucauuuuagcuacagucccccauaauuuaacaacaaucacaaagccacuaaaauauaguuauauuaacaaaugcucacgcuuauuaucggacgaucgcacggaaguuccccaauuaguaaaugcuaaucaauacaguccuugcguauccaucguaccaaguacaguaugggaggauggcgacuacuauagaaaacaacuaucucccuuggaagguggaggcuggcuuguagccaguggcucgacuguagcaaugacagaacaacuacaaauggguuucggaauaacaguccaauauggaacagacacuaacaguguuugcccaaaacuagaauuugcuaacgauacaaaaauagcaucgcaacucgguaacuguguagaauauucccuauaugguguuucaggaagaggaguuuuucaaaauuguacggcaguagguguuagacaacagcgcuuuguauacgaugcuuaccagaaucucguaggcuacuauagugaugacggcaauuauuauugccuaagagcauguguaucaguaccaguaucagucauuuacgauaaagaaacaaaaacucaugcaacacucuucggaucagucgcuugcgaacacauuucuucuaccaugucccaauacucaagaucaacccguaguaugcucaaaagacgagauucuacuuauggaccauuacaaacuccagucggaugcguucucggccuagugaacucaucucuauucguagaagauugcaaucuuccauuaggucagucccuaugugcauugccugauacaccauccacacuaacaccauaa

SEQ ID NO: 2246 - RNA, 2244 nt, Artificial Sequence
  derived and/or modified CDS sequence (opt6) from MERS-CoV__ALA49473__S1
augauacacucaguauuucuacucauguucuuacuaacaccaacagaaucauacguugauguugguccagauuccguuaaaucugcaugcauugaaguagauauccaacaaaccuuuuucgauaaaacauggccuagaccaauagauguuucuaaagccgauggcaucauauacccacaaggccgcacguacagcaauauaacaaucacauaccaaggacuuuuuccauaccaaggggaucacggugauauguacguuuauucagcaggucacgcuacaggaaccaccccucagaaauuauucguagccaauuauucccaagauguuaaacaauuugcaaacgguuuuguugugcgaauuggagcagcagcaaauucaacuggcacaguaauuauuucuccuucaacaucugcaacuauaagaaaaauuuaucccgcuuucaugcucggauccucuguaggaaauuuuucugacggaaaaaugggacgcuucuuuaaccauacucucguacuauuaccagacgguugcggaaccuuacuacgugcuuucuacuguauacuugaaccaagaucaggcaaucacugccccgcaggcaauucauauaccucauuugcuacauaucauacccccacgacagacuguucugacggaaacuauaauagaaacgcaucguuaaauucuuuuaaagaauauuuuaaccuccgcaauuguaccuuuauguacacauacaacauaacugaagaugaaauacuugaaugguucggaauaacucaaacggcucaaggaguucaucuauuuagcucacgauauguagaccuauacggcggcaacauguuucaauuugcaacucuacccgucuaugauacuauaaaauauuauucaauuauaccccauagcauaagauccauacagucugaccgaaaggcaugggcagcuuucuauguauauaaacuacaaccauuaacauuuuuacuggauuucagcgucgacgguuacauccgacgugcaauugacuguggguucaaugauuuaucccaacuucauuguucuuacgaaaguuuugauguagaaucaggugucuauucaguaucaaguuuugaagccaagccaucuggcucaguaguugaacaagcagaaggaguagaaugugacuuuucaccccuacuauccggcacaccuccacaaguauauaacuuuaaacgccuagucuuuacaaacuguaauuauaauuuaacuaagcuacucagcuuauuuucuguaaaugacuucaccuguucccaaauuucacccgcagcaauagcauccaauugcuauuccaguuuaauucuagacuauuucucuuauccgcuaagcaugaaaagugaucuaaguguaucaucugcuggccccauaucucaauucaacuauaaacaaucauuuaguaauccuacauguuuaauacuagcuacgguuccccauaauuuaacaacaauaacuaaaccuuuaaaguacucauauauaaauaaaugcucuagacuucuuuccgacgauagaaccgagguuccccaguuaguaaaugcaaaccaguacuccccuuguguuaguauugucccuucuaccguaugggaagauggcgauuauuaucgcaaacaacuuagccccuuagaaggaggcggcuggcucguagcgucaggcucuaccguagccaugacagaacaacuucaaaugggauucgguaucacuguacaauacggaacugacacaaauucuguuugcccaaaacuagaauuugcuaacgauacaaaaaucgcuucgcaacuaggaaacugcguagaauauucucuuuacggaguuucuggacgaggaguuuuucaaaacugcacugcugucggaguaagacaacaaagauuuguauaugacgccuaccaaaaccuuguuggauauuauucagacgacggcaacuacuacugcuuaagggcaugcguuagcguacccguaucugucauuuaugauaaagaaacaaaaacacaugcuacacucuuuggaaguguugccugcgaacacauaagcuccacaaugucccaauauucacguuccacaagaucaaugcuaaaacgucgagauucaaccuaugguccauuacaaaccccaguuggcugcgucuuaggccucguaaacucuucauuauucguagaagacugcaaauuaccucuaggacaaucauuaugugcccuaccagauacucccucgacacuuacccccuaa

SEQ ID NO: 2247 - RNA, 2244 nt, Artificial Sequence
  derived and/or modified CDS sequence (opt6) from MERS-CoV__ALA49583__S1
augauacauucaguuuuccuucuaauguuuuuauuaacaccuacugaaagcuacguugauguagguccggacuccguuaaaucugcauguauagaaguugacauacaacaaaccuucuuugacaaaacauggccacgaccaauagauguaucaaaagccgacgggauuaucuauccccaagguagaacuuauuccaauaucacgaucaccuaucagggccuuuuuccuuaccaaggagaucacggagauauguacguauauucugcuggccaugcgacaggaacaacuccccaaaaauuauuuguagcaaacuacucccaagauguuaaacaauuugccaauggcuuuguuguuagaauaggagcugcugcaaacaguacaggcacuguaauaauauccccaaguaccagcgcaacaauacgcaaaauuuauccagcauucaugcuagggaguucaguuggcaacuucagugauggaaaaaugggacgauuuuucaaucauacauuagucuuacugccagauggaugcggaacuuuauuaagagccuucuauugcaucuuagaaccccgcucuggaaaccacuguccggcaggaaacucauacaccaguuuugcuacauaucacacacccgcaaccgacuguagugauggaaacuauaacagaaacgcuucucuuaacucauuuaaagaauacuucaauuugcguaauuguacuuuuauguacacauauaacauuacugaagaugaaauacuagaaugguucggaauuacacaaacugcacaaggaguccacuuauucucaagucgguauguugauuuauacggcggcaauauguuucaauuugccacuuuaccuguuuacgacacaaucaaauacuacucaaucaucccacauaguauuagaucaauccaauccgacagaaaggcaugggcugccuuuuacguauauaaauuacaaccauuaacuuuucuacuagacuucuccguagauggauauauccguagagcaauugauuguggauucaaugaccugucacaacuccauugcucauaugaauccuucgacgucgaaucagggguauauucgguaucuucauuugaagccaaaccuucuggcucugucguagaacaagcugaaggaguugaaugcgauuucucaccucugcuaucagguacuccuccacaaguuuacaauuucaagcgacugguuuucaccaauugcaauuauaaccuaacgaaacuauuaaguuuauuuucgguaaaugacuuuaccugcucacaaaucaguccugcugccauugcaucuaauugcuauucaagccuaauucuugauuauuuuucauauccauuaagcaugaaaagugaucuaucuguaaguuccgcaggaccaauaucacaauuuaacuauaaacaaucauuuuccaauccaaccugucuaauuuuagcaacgguaccacauaaucuaacaacuauaacaaaaccacucaaauacucauacauuaacaaauguagccgucuucuuuccgacgauagaacagaaguaccacaauuaguaaacgcaaaccaauacucuccauguguauccauaguaccaucuacugucugggaagauggagacuauuauagaaaacaauuaucuccuuuagaaggaggcggauggcuaguggccucaggaucaacaguagcuaugacugaacaacuacaaaugggcuucggaauaaccguucaauaugggacggauacuaacucugucuguccuaaacuugaguucgccaacgauacuaaaauagcaucacaacuugguaauugugucgaauauucucucuauggaguuucaggccgcggaguauuucaaaauuguacagcagucggugugagacaacaaagauuuguuuaugaugcuuaccaaaaccuagucggauacuauucagaugacgguaacuacuacugucuucgcgcaugcguaucaguuccaguaucagugauuuacgauaaagaaacaaaaacacacgccacuuuauucggaaguguugccugcgaacauauaucaucaaccaugucacaauacucaagaucaaccagaaguaugcuuaaacgaagagacucaacuuacggaccccuucaaacuccuguuggauguguauuaggccuaguuaacuccucuuuauuuguagaggauuguaaacucccucuaggacaaucauuaugugcuuuacccgauacuccuucaacuuuaacacccuaa

SEQ ID NO: 2248 - RNA, 2244 nt, Artificial Sequence
  derived and/or modified CDS sequence (opt6) from MERS-CoV__ALA49649__S1
augauacauagugucuucuuacuuauguuccuccucacaccuacagaaucauacguugaugucggaccagauucaguaaaaucugcaugcauagaaguagauauacaacaaacauucuuugauaaaaccuggccaagaccuauagacguaucuaaagccgacggcauaauauacccacaaggaagaaccuauuccaauauaacaauuacauaccaaggacuauucccauaucaaggugaucacggugauauguaugucuacagugcaggacacgcaacaggaaccacacccaagaaacuauucguagcaaacuauagucaagauguuaaacaauuugcaaacggcuuugucguacgcaucggagcagcagcaaauaguacaggaacuguuauuauuucucccucaacuucagcuaccauccgcaaaaucuauccagccuuuauguuaggaucuucaguaggaaacuuuucagauggcaaaaugggucguuucuucaaccauacacuuguucuucuuccugauggauguggcacacuccuacgagcguucuacugcauccucgaacccagaucuggaaaucacugccccgcgggcaauuccuacaccuccuuugcaacauaccauacgccagcuacggacuguucagauggaaacuauaacaggaaugcuucucuaaacucauucaaagaauacuuuaaucuuagaaauuguacauucauguauaccuauaauauaaccgaagaugaaauacuagaaugguucggaauaacccaaacugcacaagguguucaccuuuucucaucgcgauacguagauuuauauggaggcaacauguuucaauucgcaacauuaccaguauaugauacaauaaaauauuacucaauaauaccacacaguauacgaucaauacagagcgaucgcaaagcaugggccgcuuucuaugucuauaaauuacaaccauuaacuuucuuacucgacuuuucgguugacgguuauauuagacgcgccauugacugcggauuuaaugacuuaucucaacuacauuguucauaugaaucauucgacgucgaauccgguguauauucaguaucaucauuugaagcaauuccaucaggcuccguaguagaacaagcugaagguguagaaugugauuuuucaccccuccugucaggcacuccaccacaaguuuauaauuucaaaaggcuaguuuuuacaaauugcaacuacaauuugacaaaacuauuaucucuuuucucagucaaugauuuuacauguucacaaaucucuccugcugcuauagcuucuaauuguuauuccucuuuaauacuugacuacuucucauauccacuaucuaugaaaucagacuuaucgguaucaucagccggaccgauaucacaauuuaacuacaaacaaaguuuuucaaacccaaccuguuuaauacuugcuacaguuccacauaaucuaacgacaauaacuaaaccucuaaaauacucauauauaaacaaauguucuagauuacucucugacgauagaacagaagugccacaacucgugaaugcaaaccaauacuccccuugcguaucaauagucccaucgaccguuugggaagauggcgacuauuacaggaaacaauuaucaccuuuagaagggggagguuggcucgucgcaucugggucuacuguagcaaugacagaacaacugcaaaugggauuuggaaucacaguucaauauggcacugauacaaauucaguuugccccaaacucgaauuugccaaugauaccaaaauagcaagucaacuuggaaauuguguugaauauucacuguacggaguaucaggacgugguguauuccaaaauugcacagcagucggaguaagacaacaacgcuuuguauacgacgcauaucacaaccuuguuggauacuauuccgacgauggcaacuauuacugccugagagcaugugucagcguaccuguaaguguaauauacgacaaagaaacaaaaacccaugccacacuuuuugguucagucgcaugcgaacauauuucauccacgaugucucaauacagucgaucaacacguucuaugcuaaaaagacgagauuccacauacggacccuuacagacaccgguaggcuguguccuuggccuaguaaacucuagcuuauuuguagaagauuguaaauuaccccucggacaauccuuaugcgcccuuccagacacucccucaacucucacaccauaa

SEQ ID NO: 2249 - RNA, 2244 nt, Artificial Sequence
  derived and/or modified CDS sequence (opt6) from MERS-CoV__ALA49660__S1
augauacauucaguguuccuuuuaauguuucuccuaaccccaacagaauccuauguugaugugggccccgauagcguuaaaucagcaugcauagaaguagauauacaacaaacauucuuugauaaaacauggcccaggccaauagacguaagcaaagcugauggcauaauauauccacaaggucgcacauauucuaauauaacuauaacuuaccaggguuuauuucccuaccaaggugaucacggggauauguacguauacucagccggacaugcaaccggaacaacaccacaaaaacuuuucguugccaauuacagucaagacguaaaacaauucgcaaacggauuuguaguuagaauuggugcagccgcuaauucgaccggaacaguuauuauaagcccuuccacauccgcuacuauuagaaaauucuauccugcauuuaugcuugguucgaguguaggcaacuuuuccgauggaaaaaugggaagauucuuuaaccauacucuuguauuauuaccugacggcuguggcacacucuuaagagccuucuauuguauucuugaaccuagauccgguaaucauuguccagcagguaauuccuauaccuccuucgcaacguaucauacacccgcaacugauuguucagauggaaauuacaaucgaaacgcauccuuaaauucuuuuaaagaauacuucaaccuaagaaacuguacauuuauguacacguacaauauaacagaagacgaaauacuagaaugguuuggaauaacucaaacagcccaaggaguccaccuauuuagcucccgauauguagaccuauauggcggcaauauguuccaauuugcgacacuaccugucuacgacacaauaaaauacuauucaaucauaccccauucaauacguagcauucaauccgaccgaaaggcuugggccgccuucuacguuuauaaauuacaaccucucacuuuccuccuagacuucucuguagauggguauauacgccgggcaauagauugcggcuuuaacgacuuaagucagcuacauuguuccuaugaauccuucgauguagaaucugguguauacagcguauccucuuucgaagcaaaaccgagcgguagcguaguagaacaagcugaagguguagaaugugauuucuccccucuacuaucagguacaccaccacagguauacaacuuuaaacgucuaguauucacaaauugcaauuacaaucucaccaaacuucucucgcuauuuuccguuaacgacuuuacuugcucgcaaauauccccugcugcaauagcuucaaacugcuauucuagccucauauuagauuacuucucuuacccccuaucaaugaaaucagacuuaagcguaaguuccgccggccccauaagccaauuuaacuauaaacaauccuucucaaauccaaccugccuaauauuagcaaccguuccccauaacuuaacaacaauaaccaaaccauuaaaauacucuuauauaaacaaguguucgagauuacuuucugaugacagaacggaaguuccccaauuagugaacgccaaucaauauucgccauguguauccauaguaccuucgacaguaugggaagacggagauuauuaucgcaagcaauuaaguccccuugaaggaggaggaugguuagucgcuucaggaucgacaguagcaaugaccgaacaauuacagaugggauuuggaauuacuguccaauacggcacagauacaaacucaguauguccaaaacuagaguucgcaaaugauacaaaaauagcaagucagcucgguaauuguguagaauacucccucuauggagucucuggacgaggcguauuccaaaauuguacugcaguuggaguucgacaacaaagauuuguuuaugacgcuuaccaaaauuuaguuggauauuauucugaugaugggaacuacuacuguuuacgugcauguguaucaguaccuguaaguguuauauacgauaaagaaacaaaaacucaugccacuuuauuugguuccguagcaugcgaacacauaucaucaaccaugagccaauauagucgcaguacaagaucuaugcuaaagcguagagauagcacauacggaccauuacaaaccccaguuggaugcguauuaggccuagucaacaguucacuuuucguugaagacuguaaauuaccacuaggacaaaguuuaugugcucucccggauacaccuucuacccuaacgcccuaa

SEQ ID NO: 2250 - RNA, 2244 nt, Artificial Sequence
  derived and/or modified CDS sequence (opt6) from MERS-CoV__ALA49671__S1
augauacacucaguauuucuacuaauguuuuugcuaacuccaacagaauccuauguugacguagguccugacucuguaaaaagugcaugcauugaggucgacauacagcaaacauuuuucgacaagacauggccacgacccauagauguuucaaaagccgacgguauuauuuacccacaaggacgaacauacucuaauauuacgauaacauaucaagguuuauuuccauaccaaggagaccauggagacauguaugucuauucugcaggccaugcuacaggaacaaccccucaaaaauuauuugucgcuaauuauucacaggacguaaaacaauuugcuaacggauucgucguucgcauaggcgcagcugccaauuccacuggaacaguaauaauaaguccuucaaccucugccacuauacgcaaaauauauccagcguuuauguuagguucauccguuggaaauuuuagugacggaaaaaugggacgauucuucaaucauacauugguauuacuaccagaugggugcggaacauuacuaagagcuuuuuauuguauccuagaaccucgauccggaaaccacugucccgcgggcaauucuuauacuagcuucgcuacuuaccauaccccugcaacuaauugcagcgacggcaauuauaaucgcaacgcauccuuaaauuccuucaaagaauacuucaaucuacgaaauuguacauucauguacacauacaauauaacggaagaugaaaucuuagaaugguuuggaauaacccaaaccgcacaaggaguucauuuauuuucaucucgcuacguugaccuauauggaggaaacauguuucaauucgcuacauuaccuguauaugauacuauaaaauauuacucaauuauuccacacaguauaagaaguauccaaucagacagaaaggcaugggcugcauuuuacguauauaaauuacaacccuuaacauucuuacuagacuuuucagucgauggcuacauuagacgcgcaauugacugcggauuuaacgaucuaucgcaauuacauuguucuuaugaaucauucgacgucgaaucagguguuuauucaguauccuccuucgaagcaaaaccuucaggauccguaguugaacaagcagaaggagucgaaugugauuucucuccauuauuaaguggaacuccaccucaaguauacaacuucaaacgacuuguauuuacaaauuguaauuacaacuuaacaaaacuacuuucucuauuuucuguaaaugacuuuacgugcagucaaauuucuccugccgcgaucgccucaaauuguuacucaucccuuauuuuagauuacuuuucuuauccuuuaucaaugaaaucugaccucucgguaucaucagcuggcccuauaucucaauuuaauuauaaacagucuuuuucuaauccgacuugucuaauacuugcaaccguuccccauaaucuuacuacaauaacaaaaccauuaaaguauagcuauaucaauaaaugcucucgacuauuaucagacgaccgcaccgaagucccccaacucguuaaugcgaaccaauauucaccuuguguauccauaguaccaucuacuguaugggaagauggagacuauuacagaaaacaacuaucgccuuuagaagguggcggauggcuaguagccucaggaucaacaguagccaugacggaacaacuucaaaugggcuucgggauuaccguacaauauggaacagacacaaauucaguaugucccaaacuagaauuugccaacgauacuaaaauagcuucacaacuagggaacuguguggaauauaguuuguacggagugagcggucgaggaguauuccagaacuguacagcagucggagugcgucagcaaagauuuguauacgaugcauaucaaaauuuggucggcuauuauagcgacgauggcaauuauuauugucuacgugccugcgucucuguucccguaucugugaucuaugacaaagaaacaaaaacucacgcaacauuauucggauccguggcuugugaacacauauccucaacaaugucccaauauucucguagcacccggucuaugcuaaaacgucgagacucuaccuacggcccccuacagacuccugugggauguguacuaggauuagucaauagcucccucuucguagaggacuguaagcuaccgcucggacaaaguuuaugugcguugccagauacuccuucaacacuuacaccauaa

SEQ ID NO: 2251 - RNA, 2244 nt, Artificial Sequence
  derived and/or modified CDS sequence (opt6) from MERS-CoV__ALA49682__S1
augauacauucaguauuuuuauuaauguuuuuacuaacuccuaccgaaucauacgucgauguuggaccugacuccguuaaaucugccugcauugaagucgacauucagcaaacauucuuugauaaaacuuggcccagacccauugauguaucaaaagccgacgggauaauauauccacaaggaagaacuuauaguaacauaacaauaacuuaucaaggucuuuuuccauaccaaggugaucacggggacauguacguauauuccgccggacacgcuacuggaaccacaccucaaaaacuguuugucgcaaauuauucccaagauguaaaacaauuugcaaacggguuuguuguacguauaggagcagcugcaaacuccaccggaacagucaucauuucaccaucuacauccgcaacgauacgcaagauauacccagcauucauguuaggaagcucaguaggcaauuucagugaugguaaaaugggaagauuuuucaaucacacacuuguauuacucccugaugguugcgguacauugcuucgugcauuuuacuguauacucgaaccuagaagcgguaaucacugcccugcuggaaauuccuacaccagcuucgcuacuuaccauacacccgcgacugacuguucugaugggaacuauaacagaaacgcaucacuaaauucauuuaaagaauauuuuaauuuaagaaacugcacuuuuauguauacauacaauauaacugaagaugaaauccuugaaugguucggcauuacacaaacugcacaaggaguccaucuauuuucuucacgauacguagaccuauacgggggaaauauguuucaauuugcaacuuuaccagucuaugacacaauuaaauauuacucuauaauaccacacuccauucgaucuauacaauccgaccgcaaagcaugggcagcauucuacguuuacaaauuacaaccuuuaacuuuccuauuagauuucaguguagacgguuauauaagacgcgcaauagauugugguuuuaaugaucugucacaauuacacuguucauacgaaucauucgacgucgaaagcggaguauacucaguuucgagcuuugaagcuaaaccaucaggaucaguaguugaacaagcagagggcguugaaugcgauuucucaccauuauuguccggcacaccaccucaaguauauaauuuuaaacgauuagucuuuacaaauugcaauuacaaccuuacaaaacuccucucacucuucucaguaaacgauuuuacaugcagucaaauaucaccagccgcaauagccuccaauuguuacucaucauuaauauuagacuacuuuucuuacccacuaucaaugaaaagcgacuuauccguuucuagcgccggcccuaucucacaauuuaacuauaaacaauccuucucaaacccaacuuguuuaauacuagccacaguuccccacaaucucacgacaauaaccaaacccuuaaaauacucauauauaaauaaguguucuagauugcuaucagaugaccguacagaaguaccucagcuaguuaacgcaaaccaauacucaccauguguaaguauaguaccaucaacaguaugggaagauggagacuacuauagaaaacaacugucuccauuagaaggaggaggaugguuaguagccucugguucaacaguagcaaugacagaacaacuacaaaugggauuuggcauuaccguacaauacgguaccgauaccaauaguguauguccaaaauuggaauuugcuaaugacacgaaaauugccucgcaauuaggaaauuguguagaauauucuuuauacggagugucaggaagaggcguauuccaaaacuguacagcaguaggaguacgacaacaaagauuuguuuaugaugcuuaccaaaaccucguaggauacuauucagacgacggcaauuacuacugucuucgcgccugcguuucugucccuguaagcguuauuuacgauaaagaaacaaaaacucaugcuacgcuauucgguucuguggcaugugaacauauaaguucaacuaugagccaauauucacgaaguaccagaucaaugcucaaacggagggauucaacauauggaccauuacaaacaccaguaggauguguccuuggccuuguaaauucaagccuauucguagaagacuguaaauuaccccucggacaaucucuuugcgccuuaccagacacaccauccacacuaacaccauaa

SEQ ID NO: 2252 - RNA, 2244 nt, Artificial Sequence
  derived and/or modified CDS sequence (opt6) from MERS-CoV__ALA49803__S1
augauacacucagucuuucuacuaauguucuuacucaccccaaccgaaaguuaugucgaugugggaccggacuccguaaaaucugccuguauugaaguagauauacaacagacauucuuugacaaaacuuggcccagaccaauagauguuucuaaagccgacggaauaauauacccccaaggccgaacguauucaaacauaacaauaaccuaucaaggucuauuuccuuaucaaggcgaccacggugaccguuacguauacuccgcuggccaugcaacaggaacuacaccacaaaaacuuuuuguagcaaacuauagucaagacguaaaacaguucgcaaauggauucgucguuagaaucggagccgcagcaaauuccaccggaaccguuauuauuaguccuuccaccucagcaaccauaagaaaaaucuacccugccuuuaugcucgggaguucggucggaaacuuuucagacggcaaaaugggacgcuuuuucaaucacacccuaguacucuuacccgauggaugcggaacuuuacuaagagcauucuauuguauccucgaacccagaaguggaaaccauugcccggcugguaacucauacacuuccuuugcaacguaccacacacccaguacggacugcucagaugguaauuauaaucgaaacgcaagccuaaauucauuuaaagaauacuuuaaucuacgaaauugcacuuuuauguacacauauaauauaacggaagacgaaauacuugaaugguucgguauaacacaaacagcucagggaguacaucuauucucgucgcgcuacguugauuuauauggaggaaauauguuucaauuugccacauuaccuguuuaugacacuaucaaauauuacucaauuauaccucacuccauacgcucuauacaauccgaccgaaaggcuugggcugcuuuuuauguuuacaaacuucaaccuuuaacauuuuuacuagacuucaguguagacgguuauauuagacgcgcaauugacugcggcuuuaaugaucuaucacagcuacacuguucguacgaaucuuuugacguagaaaguggaguauauucaguaucuuccuuugaagccaaaccaucagguucggucgucgaacaagcagaaggaguagagugugacuuuucaccacuucuuaguggcacuccaccccaaguauauaauuucaaaagauuaguuuuuaccaacuguaauuauaaccucacaaaacuacucucauuauuuucaguaaaugauuucacuuguucacaaaucagucccgcggcuaucgccagcaauugcuauaguucacuaauauuagacuauuuuucauauccacuuaguaugaaaucagaucuuucugugucaucagcaggaccaauuucacaauucaauuauaaacagucauucucaaacccaacauguuuaauuuuagcaacagucccucauaaucuaacaacaauaacuaaaccauuaaaauauaguuacauuaauaaaugcucaagacuuuuaagugacgaccgaacagagguuccacaauuaguaaacgcaaaccaauauucaccuuguguaucgauuguacccucgacuguaugggaagauggugacuauuauagaaaacagcucucaccacuagaagguggcggaugguuaguagcgaguggaucaacugucgcuaugacagaacaacuacaaaugggauuuggcauaacuguacaguacggaacggauacaaacucagucuguccaaaacucgaguuugcuaacgacaccaaaauagcaucacaauuaggaaauugcguagaauacucacuauauggcguaucaggaagaggggucuuucaaaacuguacagcaguaggaguacgacaacaaagauuugucuacgaugcauaucaaaacuuagugggauauuacuccgaugacgguaacuauuauuguuuaagggcuuguguaucagugccuguuucaguaaucuacgauaaagaaacuaaaacccacgccacucuguucggauccguugcaugugaacauauaucaucuacuaugucacaauauuccagaucgacuagaagcaugcuaaaaagacgagacucaacauauggaccccugcaaacuccuguaggcuguguauuaggucuaguaaauucaucauuguuuguugaggauuguaaacuuccccucgggcaaagucuaugugcauuaccugauacaccauccacucucacacccuaa

SEQ ID NO: 2253 - RNA, 2244 nt, Artificial Sequence
  derived and/or modified CDS sequence (opt6) from MERS-CoV__ALA49836__S1
augauacauuccguuuuccuucucauguuucuucuuacucccacagaauccuauguagacguagguccagauuccguaaaauccgcuugcauagaaguggauauacaacaaacauucuucgacaaaacuuggcccagaccgaucgaugucucaaaggcugacggcaucauuuacccacaaggacgaacuuacucaaacauaacaauaacuuaucaagguuuguuuccauaccaaggcgaccacggugacauguauguauacucggcuggucacgcuacaggaacaacaccucaaaaacucuucgucgcaaauuauagucaagauguaaaacaauuugcaaacggauuuguaguuaggauaggcgcugcagcaaauucuacuggcaccguuaucauauccccaucuacaucagcaacaauccgaaaaauauaucccgcauuuauguuaggcucuagugucggcaacuuuucagauggaaaaaugggucgauucuucaaucauacccuaguauuauuacccgauggauguggaacacuacuacgcgcuuucuacuguauucuugaaccucgauccggaaaucauugccccgcgggcaacucauauacaucauuugcaacauaccauacuccugcaacagauugcucagacggcaacuacaaucgcaacgcaucccuaaacagcuuuaaagaauacuucaaccuacguaacuguacauuuauguauacauacaauauaacagaagacgaaauauuagaaugguuuggcauaacucaaacagcccagggcguacaucuauucucaaguagauauguugaccuuuauggaggaaauauguuccaauucgcuacauuaccaguuuacgacacaauuaaauacuauaguauaaucccacauaguauacgaucaauacaaucugauaggaaagcaugggcagcauucuacguauacaaauuacaaccauugacuuucuuacuagacuucaguguugacggcuauauucgcagagcuauagacugcgguuuuaaugaccuuucacaguuacacugcucuuaugaaucuuuugauguagaaucuggaguuuacuccguaucaucuuucgaagcaaaaccaucuggauccguugucgagcaagcagaaggaguagaaugcgauuucucaccacucuuaucuggaacaccuccccaaguuuauaacuucaaacgucucgucuuuacuaacuguaauuauaaccuaacaaaacuuuuaucacuauuuagcgucaacgacuucacauguucacaaauaucacccgccgcaaucgcuucuaauuguuauucaucauuaauacucgauuauuucaguuauccauuauccaugaaaucggacuuaucagucaguucugcuggaccaauuagucaauuuaacuauaaacaaucuaguucaaacccgacauguuuaauucuagcaacaguaccacauaauuuaacuacaauuacaaaaccucugaaauauagcuauauaaauaaauguucuagguuauuaucagacgaccgcacagaggucccucagcuagucaaugccaaccaauacucgccuugcguauccauaguuccuucaaccguaugggaagauggugauuauuaucgaaaacaacuaucacccuuagaaggaggugguuggcuuguagccucugguucaacuguugcaaugacugaacaacuucaaaugggcuucggaauaacaguucaauauggcacggacacaaacuccguaugucccaaauuagaauuugcgaaugauacaaaaauagccagccaauuaggaaauugugucgaauacucacuauauggugucucagguagaggcguauuucaaaacugcacagcaguggggguacgacaacaaagauuuguauaugacgcauaccaaaaucuaguaggauauuacucggaugacggcaauuacuacuguuuacgagccuguguuucaguacccgucagcguuauauacgauaaagaaaccaaaacacaugcaacacuauucggauccguggcaugcgaacacaucucgucuaccaugucacaauacucuagaucaacccgcucaaugcuaaaacgccgagacucaacuuaugguccuuuacaaacuccaguugguuguguccuaggccuagucaauucuagucucuucguagaagauuguaaauuaccacuaggucaaucacuaugcgcccuaccagauacuccaucuacuuuaacacccuaa

SEQ ID NO: 2254 - RNA, 2244 nt, Artificial Sequence
  derived and/or modified CDS sequence (opt6) from MERS-CoV__ALA49957__S1
augauacacaguguuuuucuccuaauguuccuccuaacuccuacagaaucauaugucgacguaggaccugauucaguuaaaucagcaugcauagaaguugauauacaacaaacauucuuugacaaaaccuggccacgucccaucgacgucucaaaagcagauggaauuauauauccccaagguagaaccuauaguaauauaacuauaacauaucaaggccucuuuccauaccaaggcgaccauggugauauguauguguauuccgccggucaugcuacaggaacuacaccucaaaaacucuucguugcaaacuauucacaagauguuaaacaauucgcaaacggcuuuguugugagaauuggugcagccgcuaacucaacaggaacuguuauaaucucaccgucaacuucugcaacuauucgcaaaauauauccagcuuucaugcuaggaucaucaguugguaacuuuucugauggaaaaaugggccguuucuuuaaucauacacucguccuauuaccugauggaugugguacgcuacuaagagcauuuuacugcauauuagaaccccgaagugguaaccauugcccugcaggaaauucauacaccucuuuugcaacauaucacaccccugccacggauuguucagauggaaauuauaaccggaacgcaucauuaaauucauuuaaagaauauuucaauuuacguaacuguacauuuauguacacauacaauaucacagaagaugaaauacucgaaugguucggaauuacccaaacugcucaagguguccaccuauucucuucccgcuaugucgacuuauacggagguaauauguuccaauuugcaacacuaccugucuacgacacaauuaaauauuacaguauuauuccacacucuauccgaagcauccaaucugaucguaaggcuugggcagcauuuuacgucuauaaauuacaaccccuaacuuuucuucuagacuucaguguagauggcuauauacgcagagcuauagauuguggcuucaaugaccuuucacagcuucauugcucauaugaauccuuugacguagaauccggaguuuauuccguaucaucuuucgaagcaaaacccuccggaucaguaguugaacaagccgaaggcguugaaugugauuuuucaccacuacuuucagguacacccccucaaguuuacaacuuuaaacgauuaguuuucacaaauugcaacuauaaucuaacaaaacuauuaucccuauucaguguaaaugauuucacauguucucaaauaucaccagcagcuaucgcaagcaauugcuauucaucauuaauauuagauuauuucaguuauccacucuccaugaaaucagaucuaucaguaucaucagccgguccaauuucccaauucaacuauaaacaaucuuuuucaaauccuaccugucugauauuagcuacuguaccucauaaucuaacuacaauaacaaaaccauuaaaauacagcuacauaaacaaauguucuagacuacugagcgaugacagaacagaaguuccccagcuaguaaaugcgaaucaauauuccccaugugucaguaucguuccgucaacugucugggaagacggagacuacuacaggaaacaauuaagcccauuagaagguggagggugguuaguagcaucagguucaaccgucgcaaugacagaacaacuucaaauggguuucggaauuacaguacaauacgguacagauacuaacucaguuugucccaaacuugaauuugccaacgacacgaaaaucgcuucccaacuuggaaauugcguagaauacucuuuauauggaguaucaggaagagguguauuucagaacugcacagcaguggguguucgacaacaacgauuuguauaugacgcauaucaaaauuuaguaggauauuacucagaugauggaaacuauuauugucuuagggccugcguuucaguuccaguuucaguaauauacgacaaagaaacuaagacccacgcuacuuuauuugguucagucgcuugcgaacacauaucuaguacaaugucacaauauucacgaucaaccagaucuaugcuuaagcgaagggacucaacauauggaccgcugcaaaccccugucgguugcguacuaggacuuguaaauucgucauuauuuguagaggacuguaaauuaccucuaggucaaucucuuugcgcacuucccgacacacccucuacacugacccccuaa

SEQ ID NO: 2255 - RNA, 2244 nt, Artificial Sequence
  derived and/or modified CDS sequence (opt6) from MERS-CoV__ALA50067__S1
augauccauucgguauuucucuugauguuucuuuuaaccccgaccgaauccuacguagacgucggcccagauuccguaaaaucagcuugcauagaaguagauauccaacaaacauucuuugacaagacuuggccaaggcccauugacguaucuaaagcagaugguauuaucuacccucaaggaagaacauauuccaauauaacaauaacauaccagggccuauuuccauaucaaggugaccauggcgacauguacgucuauucagcaggucacgcuacugguacaacaccacaaaaacuauuugucgcaaacuauucacaagacguuaaacaauuugcuaauggauucguagugcgcauaggugcugcagccaauuccacaggaacaguuauuauaaguccuucaacaucagcaacaauucgcaaaauuuauccugccuuuaugcuuggaagcucaguaggcaauuuuucugauggcaagauggguagauucuuuaaccacacuuuaguacuucuaccggacggauguggcacucuacuucgcgccuuuuauugcauucuagaaccaagaucaggaaaucauuguccugccggaaacaguuacacuuccuucgcaacguaccauacaccagcaacagauuguucugauggcaauuacaauagaaacgcauccuuaaacucauuuaaagaauauuuuaauuuacgaaacuguaccuucauguauacuuauaauauuacagaagacgaaauacuugaaugguuugguauaacgcaaacugcacaaggaguucauuuguuuagcucacgauacguagaccucuauggaggcaacauguuucaauuugccacucugccuguauacgauaccaucaaauauuauucuauaaucccccacuccauucgcucaauacaaucagauagaaaggcuugggcugcguuuuauguuuauaaacuucaaccgcuuaccuuuuuauuagacuucagcguagauggcuauauacgacgggcuaucgauuguggauuuaacgauuuaucacaacuccauugcucauaugaaucuuucgacguagaaucuggaguuuacucuguuaguucuuuugaagcgaaaccaucugguuccguaguagaacaagcugaaggaguagaaugugauuucagcccccuacuuucaggcacucccccacaaguauacaauuucaagcgauuagucuuuaccaacugcaauuacaauuuaacaaaauugcuaucccuauuuucaguuaaugacuuuaccuguucacaaauaucuccugccgcuauagcaucaaacugcuauucuucauuaauuuuagauuauuuuucauauccacuauccaugaaauccgaucuuucuguaucgucaucaggcccaauaucacaauucaauuauaaacaaucauuuucaaacccuacuugcuuaauacuugcaaccguaccccauaaucuuaccacuauuacuaaaccuuuaaaauauaguuacauaaauaaaugcucaagguuauuaucugaugauagaaccgaaguuccccagcuugucaaugcuaaucaauacuccccaugcguaucaaucguccccucaacaguaugggaagacggagauuauuacagaaaacaauuaucuccauuagaagguggaggauggcucguggcaucagguucgaccguugccaugacugaacaauuacaaauggguuuugggaucacuguacaauacggaacagauacuaacucuguauguccuaaacuagaauuugcaaaugauacaaaaauagccagucaauuagguaacugcgucgaauacuccuuauaugggguaucugggaggggcguuuuucaaaauugcacagcaguagguguucgccaacagagauuuguguacgaugcuuaucaaaauuuaguaggguacuacucugacgacggaaauuacuauugccuacgagccugugugagcguuccugucuccguaauauacgacaaagaaacaaaaacucaugcuacauuauucggcucuguagcuugcgaacacaucucuaguaccaugucgcaauacucuagaucaacacguaguaugcuuaaacgaagggauucaacauacggcccauuacaaacaccaguaggauguguacucggucucgucaauucuucccuuuuuguggaagauuguaaacucccauugggccagucucucugcgcccuuccugauacuccaaguacuuuaacaccauaa

SEQ ID NO: 2256 - RNA, 2244 nt, Artificial Sequence; identical to SEQ ID NO: 1650
  derived and/or modified CDS sequence (opt11) from MERS-CoV__AFS88936__S1

SEQ ID NO: 2257 - RNA, 2244 nt, Artificial Sequence
  derived and/or modified CDS sequence (opt11) from MERS-CoV__AFY13307__S1
augauccacagcguguuccugcucauguuccuuuuaacccccaccgaguccuacgucgacgugggcccggacagcgugaagucugccugcaucgaggucgacauccagcagacguuuuucgacaagacuuggccccgccccaucgacgugucaaaggccgacgggaucaucuacccccagggccguaccuacucgaacaucaccaucacguaccaaggccucuucccguaccagggcgaccacggggacauguacguguacagcgcgggccacgcaaccggcaccacgccccaaaagcuguucgucgccaacuacucccaggacgugaagcaguucgccaacggcuucguggucagaaucggcgcagcggccaacagcaccgggaccgugaucaucucccccagcaccuccgccaccauccggaagaucuaccccgccuucaugcugggcagcuccguggggaacuucagcgacggcaagauggggcgcuucuucaaucacacgcucguccugcugccggacgggugcggcacccuccugcgagcguucuauugcauccuggagccccgcuccgggaaccacugccccgccggcaacagcuacaccuccuucgccaccuaccacacgcccgccaccgacugcagcgacggcaacuacaaccggaacgcguccuuaaacagcuucaaggaguacuucaaccugcgcaacugcaccuucauguacaccuacaauaucacggaggacgagauccuggagugguucgggaucacccagaccgcgcagggcgugcaccuuuucagcucccgguacguugaucuguacgggggcaacauguuccaguucgccacccugccggucuacgacacgauuaaguacuauagcaucaucccccacuccaucagaagcauccaguccgaccggaaggccugggccgccuucuacguguacaagcuccagccccugaccuuccugcuagacuucagcguggacggguacauccgcagggcaaucgacugcggcuucaacgaccugucccagcugcacugcagcuacgaguccuucgacgucgagagcggcguguacuccgugagcuccuucgaggccaagcccagcggguccgucguggaacaggccgagggcguggagugcgacuucagcccgcuccuguccgggaccccgccccaggucuacaacuucaagcgccugguguucaccaacugcaauuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcagugcagggcccaucagccaguucaacuacaagcaguccuucagcaacccgaccugccugauccucgccaccgugccccacaaccugaccaccauaaccaagccccugaaguacuccuacaucaacaagugcagccgguuccucuccgacgaccgcaccgaggucccccaacugguaaacgccaaccaguacagccccugcguguccaucguccccagcacggugugggaggacggggacuacuaccggaagcagcugagcccgcucgagggcggcggguggcugguggccuccggcagcaccgucgcgaugacugagcagcugcagaugggguucggcaucaccguccaguacgggaccgacacgaacuccgugugccccaagcucgaguucgccaacgauaccaagaucgccagccagcugggcaacugugucgaguacucccuguacggcgugagcgggcgcggcguguuccagaacugcaccgccguuggggugcggcagcagcgcuucguguacgacgcguaccagaaccucgucggcuacuacuccgacgacggcaacuacuacugccugcgggccugcgugagcgugcccgucuccgugaucuacgacaaagagaccaagacacacgccacccuguucgggagcguggccugcgagcauaucuccagcaccaugucccaguacagccgcuccacccgcagcaugcugaagcggcgcgacuccacguacggcccgcuccagacccccgucgggugcgugcugggccuggugaacagcagccucuucgucgaggacugcaagcugccccuggggcagagccucugcgcccugcccgacaccccgagcacccugacgcccuga

SEQ ID NO: 2258 - RNA, 2244 nt, Artificial Sequence; identical to SEQ ID NO: 1652
  derived and/or modified CDS sequence (opt11) from MERS-CoV__AGH58717__S1

SEQ ID NO: 2259 - RNA, 2244 nt, Artificial Sequence
  derived and/or modified CDS sequence (opt11) from MERS-CoV__AGN52936__S1
augauucacagcguguucuuacucauguuccugcugacccccaccgaguccuacguugacgugggcccggacagcaucaaaucagccugcaucgagguggacauccagcagacguucuucgacaagaccuggccccgccccaucgacgucagcaaggccgaugggaucaucuacccccaggguagaacuuacaguaauaucaccaucacguaccagggccucuucccguaccaaggcgaccacggggacauguacguguacagcgcgggccacgccaccggcaccacgccgcagaagcuguucguggccaacuacucgcaggacgucaagcaguucgccaauggguucgugguacgcaucggcgccgcggccaacagcacggggaccgucaucaucucccccucaaccuccgccacgauccggaagaucuaccccgccuucaugcugggcagcuccgucgggaacuucagcgacggcaagaugggccgcuucuucaaccacacgcuagugcuccugccggacgggugcggcacccuccuccgugcguucuacugcauccuggagccccgcuccgggaaccacugccccgccggcaauagcuacaccuccuucgccaccuaccacacgcccgccaccgacugcagcgacggcaacuacaaccguaacgccucccucaacucauucaaggaguacuucaaccugcgcaacuguacguucauguacacauacaauaucacggaggacgagauccuggagugguucggcaucacccagaccgcgcagggcguccaccucuucagcucucgguacguggaccuguacgggggcaacauguuccaguucgccacccugcccguuuaugacacgaucaaguauuauaguaucaucccccacuccauccgcagcauucaguccgaccggaaggccugggccgccuucuacguauacaagcuccagcccuuaaccuuccugcucgacuucagcguggacggguacauccgccgggcgaucgauuguggcuucaaugaccugucccagcugcacugcagcuacgaguccuucgacguggagagcggcgucuacuccgugagcuccuucgaggcuaagccgagcggguccguggucgagcaggccgagggcguggagugugacuucagcccgcuccuguccgggaccccgccccagguguacaacuucaagcgccuggucuucaccaacugcaacuacaaccucacgaagcugcugagccucuucuccgugaacgacuucacuugcagucagaucagccccgccgcgaucgcguccaacugcuacagcucacugauccuggacuacuucagcuacccccucuccaugaaguccgaccugagcgucagcuccgccgggccaaucucacaguucaacuacaagcaguccuucagcaacccgaccugccugauccucgccaccgugccccacaaccugaccaccaucaccaagccccugaaguacucauacaucaacaagugcagcagauugcuguccgacgaccgcaccgaggugccccagcuggucaacgccaaccaguacagccccugcguguccaucgugcccagcacggucugggaggacggggauuacuaucggaagcagcucagcccgcuggaagggggcggguggcucguggccucaggcagcacagucgcgaugaccgagcagcuccagaugggguucggcaucaccguccaguacgggaccgacacgaacucggugugccccaagcuggaguuugccaacgacaccaagaucgcuagccagcuggggaacugcguggaguacucccucuacggcguuagcgggcgcggcguguuccagaacugcaccgccgugggggucaggcagcagcgguucguguacgacgccuaccaaaaccuggugggcuacuacuccgacgacggcaacuacuacugccugcgcgccugugucagcgugcccguguccgugaucuacgacaaggagaccaagacgcacgccacccuguucgggagcguggccugcgagcacaucuccucaaccaugucgcaguacagccgcuccacccgcagcaugcucaagcggcgcgacuccacguacggcccgcugcaaacccccguggggugcguccugggucucgugaacagcucccuguucguggaggacugcaagcugccccucgggcagagccugugcgcccuacccgacaccccgaguacccucacgcccuga

SEQ ID NO: 2260 - RNA, 2244 nt, Artificial Sequence; identical to SEQ ID NO: 1650
  derived and/or modified CDS sequence (opt11) from MERS-CoV__AGN70951__S1

SEQ ID NO: 2261 - RNA, 2244 nt, Artificial Sequence
  derived and/or modified CDS sequence (opt11) from MERS-CoV__AGV08408__S1
augauccacucgguguuccugcucauguuccugcugacccccaccgagucauacgucgacgugggccccgauagcgugaaguccgccuguauagagguugacauccagcagacguucuucgauaagaccuggccccgcccuaucgacgugaguaaggccgacgguaucaucuacccccaaggccggaccuacuccaacaucaccaucacguaccagggccucuucccguaccagggcgaccacggggacauguacguuuauagcgcaggccacgccaccggcaccacaccccagaagcuguuugucgccaacuacucccaggacgugaagcaguucgccaacggauucgugguccgcaucggcgccgcggccaauucgaccgggacggugaucaucucucccagcaccuccgcgaccauccggaagaucuaccccgccuucaugcugggcucauccguggggaacuucagcgacggcaagaugggacgcuucuucaaccauacgcucguccugcugccggacgggugcgggacccuccugcgggcguuuuacugcauccuggagccccgcuccgggaaccacugccccgccggcaacagcuacaccuccuucgccacuuaccacacgcccgcuaccgacugcagcgacgggaacuacaaccggaaugccucccucaauagcuucaaggaguacuucaaccugcgcaacugcaccuucauguacaccuacaacauuacggaggacgagauccuagaaugguucgggaucacccagaccgcgcagggcgugcaccucuucagcucccgguacguggaccucuacgggggcaacauguuccaauucgccacccugccggucuacgacacgaucaaguacuacucgaucaucccccacuccauccgcagcauccaguccgaccggaaggccugggccgccuucuacguguacaagcuccagccccugaccuuccugcucgacuucagcguggacggguacauccgccgggcgauugauugcggcuucaacgaccugucccagcugcacugcagcuacgaguccuucgacgucgagagcggcguguacuccgugagcuccuucgaggccaagcccagcgggagugucguggaacaggccgagggcguggaaugcgacuucagcccgcuacuguccgggaccccgccccaggucuacaacuucaagcgccugguguucaccaacugcaacuacaaccucacgaagcugcugagccucuuuuccgucaacgacuucacgugcucgcagaucagccccgccgccauagcguccaacugcuacagcucccuaauccuggacuacuucagcuacccccucuccaugaaguccgaccugagcgugagcuccgccgggcccaucagccaguucaacuacaagcagucauucagcaacccgaccugccugauccucgccaccgugccccacaaccugacgaccaucaccaagccccugaaguacuccuacaucaacaagugcagccggcuccuuuccggggaccgcaccgaggucccgcagcuggugaacgcgaaccaauacagccccugcguguccauugucccgucgacagugugggaggacggugacuauuaccggaagcagcucagcccgcuggagggcgggggcuggcugguggccucagggagcaccgucgcgaugaccgagcagcuccaaaugggcuucgggaucaccgugcaguacggcaccgacacgaacuccgugugccccaagcuggaguucgccaacgacaccaagaucgccagccagcugggcaacugugucgaguacucacucuacggggugagcggccgcgggguguuccagaacuguacggccgucggcgugcggcagcaacgcuucguauacgacgcguaccagaaccuggucggcuacuacuccgacgacggcaacuacuacugccugcgggccugcguguccgugcccgucuccguuauauacgacaaggaaacuaagacgcacgccacccuguucggcagcguggccugcgagcacaucucaagcaccaugucccaguacagccgcuccacgaggaguauguuaaagcggcgcgacuccacguacgggccgcugcagacccccgucggcugcguguuaggucucgugaacagcagccuguucgucgaagacugcaaacuuccccuaggccagagcuugugcgcacugcccgacaccccgagcacccucacgcccuag

SEQ ID NO: 2262 - RNA, 2244 nt, Artificial Sequence; identical to SEQ ID NO: 1656
  derived and/or modified CDS sequence (opt11) from MERS-CoV__AGV08455__S1

SEQ ID NO: 2263 - RNA, 2244 nt, Artificial Sequence
  derived and/or modified CDS sequence (opt11) from MERS-CoV__AGV08467__S1
augauccacagcguguuccugcucauguuccugcuaacccccaccgaguccuaugucgacgugggcccggacagcgugaaguccgccugcaucgaggucgacauccagcagacguucuucgacaagaccuggccccgccccaucgacgugagcaaggccgacggaaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccggcaccgugaucaucucccccaguaccuccgccaccauccggaagaucuaccccgccuucaugcugggcagcagcguugggaacuucagcgacgguaagaugggccgcuucuucaaccacacucucguccugcugccggacgggugcggaacccuccugcgggcguucuacugcauccuggagccccgcuccgggaaccacugccccgccggcaacagcuacaccuccuucgccaccuaccauacgcccgccaccgacugcagcgacggcaacuacaaccggaacgccucccucaauagcuucaaggaauacuucaaccugcgcaacugcaccuucauguacaccuacaacaucacggaggacgagauccuggagugguucgggaucacccagaccgcgcagggcgugcaccuauucagcucccgcuacguggaccuguacgggggcaauauguuucaguucgccacccugccggucuacgacacgaucaaguacuacucaaucaucccccauuccauccgcucaauccagucagaccggaaggccugggccgccuucuacguguacaagcuccagccccugaccuuccugcucgacuuuagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguugagcaggccgagggcguggagugcgacuucagcccgcuccuguccgggaccccgccccaggucuacaacuucaagcgccugguguucaccaacugcaacuacaaccucacgaaguuacugagccucuucuccgucaacgacuucacgugcagccagaucagccccgccgccaucgcguccaacugcuacagcucccugauccuggacuacuuuagcuacccccucuccaugaaguccgaccugagcgugagcuccgccgggcccauuagccaguucaacuacaagcaguccuucagcaacccgaccugccugauccucgccacggugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggauuacuaccgaaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguuugccaacgacaccaaaaucgccagccagcugggcaacugcgucgaauacucccucuacggcgugagcggccgcggcguguuccagaacugcaccgccgucggcgugcgacagcagcgcuucguguacgacgcguaccagaaccuggucggcuacuacuccgacgacggcaacuacuacugccugcgggccugcgugucagugcccguauccguaaucuacgacaaggagacaaagacgcacgccacccuguucgggagcguggccugcgagcauaucuccagcaccaugucccaguacagccgcuccacccgcagcaugcucaagcggcgcgacuccacguacggcccgcugcagacccccgucggaugcgugcugggccucgugaacagcucccuguucgucgaggacugcaagcugccccucgggcaaagccugugcgcccugcccgacaccccgagcacccucacgcccuga

SEQ ID NO: 2264 - RNA, 2244 nt, Artificial Sequence
  derived and/or modified CDS sequence (opt11) from MERS-CoV__AGV08492__S1
augauccacagcguguuccugcucauguuccugcugacccccaccgaguccuacgucgacgugggcccggacagcgugaaguccgccugcaucgaggucgacauccagcagacguucuucgacaagaccuggccccgcccuaucgacgugagcaaggccgacgggaucaucuacccccaaggccggaccuacuccaacaucaccaucacguaccagggccucuucccguaccagggcgaccacggggacauguacguguacagcgcgggccacgccaccgguaccacgccccagaagcuguucgucgccaacuacucccaggaugugaagcaguucgccaacggguucgugguccgcaucggcgccgcggccaacagcaccgggaccgugaucaucucccccagcaccuccgccacgauccggaagaucuaccccgccuucaugcugggcagcuccguggggaacuucagcgacggcaagaugggccgcuucuucaaccacacgcucguccugcugccggacgggugcggcacccuacugcgggcauucuacugcauccuggagccccgcuccggcaaccacugccccgcgggcaacagcuacacguccuucgccacauaccacacgcccgccaccgacugcucagacggcaacuacaaccggaacgccucccucaacagcuucaaggaguacuuuaaccugcgcaacugcaccuucauguacaccuacaacaucacggaggacgagauccuggagugguucgggaucacccagaccgcgcagggcgugcacuuguucagcucccgguacguggaccuguacgggggcaacauguuccaguucgccacccugccggucuacgacacgaucaaguacuacagcaucaucccccacuccauccgcagcauacagucggaccggaaggccugggcugccuucuacguuuacaagcuccagccccugaccuuccugcucgacuucagcguggacggguacauccgccgggcaaucgacugcggcuucaacgaccugagccaguuacacugcagcuaugaguccuucgacgucgagagcggcguguacuccgugagcuccuucgaggccaagccuagcggguccgucguggagcaggccgagggcguggagugugacuucagcccguuacuguccgggaccccgccccaggucuauaacuucaaacgccugguguucaccaacugcaacuacaaccucacgaagcugcugagccuauuuuccgucaacgacuucacgugcagccagaucucgcccgccgccaucgcguccaacugcuacagcagucugauccucgacuacuucagcuauccccucuccaugaaguccgaccugagcgugagcuccgccgggcccaucagccaauucaacuacaagcaguccuucagcaacccgaccugccugauccucgccaccgugccccacaaccugaccaccaucacuaagccccugaaguacuccuacaucaacaagugcagccggcucuuguccgacgaccgcaccgaggucccccagcuugugaacgccaaccaguauagccccugcguauccaucguccccuccacggugugggaggacggggacuacuaccggaagcagcucagcccgcuggaaggcggcggguggcugguggccuccggcagcaccgucgcgaugaccgaacagcuccagaugggguucggcaucacggugcaguacgggaccgacacgaacuccgugugccccaagcuggaguucgcuaacgacaccaagaucgccagccagcugggcaacugcgucgaguacucccucuacggcgugagcgggcgcggcguguuccagaacugcaccgccgucggcgugcggcaacagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcauguuaaagcggcgcgacuccacguacggcccacugcagacccccgucgggugcgugcugggacuugugaacagcucccuguucgucgaggacugcaagcugccccucgggcagagucugugcgcccugcccgacaccccgagcacccucacgcccuga

SEQ ID NO: 2265 - RNA, 2244 nt, Artificial Sequence
  derived and/or modified CDS sequence (opt11) from MERS-CoV__AGV08584__S1
augauccacaguguguuccugcucauguuccuguuaacccccaccgagucuuacgucgacgucggcccggacagcgugaaguccgccugcaucgaggucgacauccagcagaccuucuucgacaagaccuggccccgccccaucgacgugagcaaggccgacgggaucaucuacccgcagggccggaccuacuccaacaucaccaucacguaccagggucucuucccguaccagggcgaccacggggacauguacguguacucggcgggccacgccaccggcaccacgccccagaagcuguucgucgccaacuacucccaggaugugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccuccgggcguucuacuguauccuggagccccgcuccgguaaccacugccccgccggcaacagcuacaccucauucgccaccuaccacacgccagccaccgacugcagcgacggcaauuacaaccggaacgccucccucaacagcuucaaggaguauuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgauaaaguacuacagcaucaucccccacuccauccgcagcauccaguccgaucggaaggccugggccgccuucuacguguacaagcuccagcccuugaccuuccugcucgacuucagcguggacggguacauccgccgggcgaucgacugcgguuucaacgaccugucccagcugcacugcuccuacgaguccuucgacgucgagagcggcgucuacuccgugagcuccuucgaggcuaagcccagcgggucagucguggagcaggccgagggcguggagugcgacuucagcccgcuccuguccgggaccccgccccaggucuacaauuucaagcgccugguguuuaccaacugcaacuacaaccucacgaagcugcugagccucuucuccgucaacgacuucacgugcagccagaucagccccgccgcgaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugaccacuaucaccaagccccugaaguacuccuacauuaacaagugcagccggcuccuguccgacgaccgcaccgaggucccccagcuggugaacgccaaccaguauagccccugcguguccaucguccccagcacggccugggaggauggggacuacuaccggaagcagcucagcccccuggagggcggcggguggcugguggcguccggaagcaccguggcuaugaccgagcagcuccagaugggcuucggcaucaccguccaguacgggaccgacacgaacucagugugccccaagcuggaguuugccaacgacaccaagauagccagccagcugggcaacugcguggaguacucccucuacggcgucagcgggaggggcguguuccagaacugcaccgcgguggggguccggcagcagcgcuucguuuacgacgccuaccagaaccuggugggcuauuacuccgacgacggcaacuacuacugccugcgggccugcgucagcguacccguguccgucaucuacgacaaggagaccaagacgcacgccacccuguucgggagcguggccugcgagcacaucuccagcaccaugucccaguacagccgcuccacccgcagcaugcucaagcggcgcgacuccacguacggaccgcugcagacccccguggggugcguccugggccucgugaacagcucccuguucguggaggacugcaagcugccccucgggcaaagccugugcgcgcugcccgacaccccgagcacccucacgcccuga

SEQ ID NO: 2266 - RNA, 2244 nt, Artificial Sequence
  derived and/or modified CDS sequence (opt11) from MERS-CoV__AHB33326__S1
augauccacuccguguuccugcucauguuccugcugacccccacagaguccuaugucgacgugggcccggauagcgugaaguccgccugcaucgaggucgacauacagcagacguucuucgacaagaccuggccccgccccaucgacgugagcaaggccgacgggaucaucuacccccagggccgaaccuacuccaacaucaccaucacguaccagggccucuucccguaccagggcgaccacggggacauguacguguacagcgcgggccacgccaccggcaccacgccccagaagcuguucgucgccaacuacucccaggacgugaaacaguucgccaacggguucgugguccgcaucggagccgcggccuacagcaccgggaccgugaucaucucccccagcaccuccgccaccauccggaagaucuaccccgccuucaugcuggggagcuccguggggaacuucagcgacggcaagaugggccgcuucuucaaccacacgcucguccuguuaccggacgggugcggaacccuccugcgggcguucuacugcauccuggagccccgcuccgggaaccacugccccgccggcaacagcuacaccuccuucgccaccuaccacacgcccgccaccgauugcagcgacggcaacuacaaccggaacgcaucccucaacagcuucaaggaguacuucaaccugcguaacugcaccuucauguacaccuauaacaucacggaggacgagauccuggagugguucgggaucacccagaccgcgcagggcgugcaccuauucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuuuagcguggacggguacauccgccgggcgaucgacugcgguuucaacgaccugucccagcugcacugcagcuaugaguccuucgacgucgagagcggcguguacuccgugagcuccuucgaggccaagcccagcggguccgucguggagcaggccgagggcguggagugcgacuucucuccgcuccuguccgggaccccgccucaggucuacaacuucaagcggcugguguucaccaacugcaauuacaaccucacgaagcugcugucccucuucuccgucaacgacuucacgugcagccagaucagcccugccgccaucgcguccaacugcuacagcucccugauccuggacuacuuuagcuacccccucuccaugaaguccgaccugagcgugagcuccgccgggcccaucagccaguucaacuacaagcaguccuucagcaacccgaccugccugauccucgccaccguuccccacaaccugaccaccaucaccaagccgcugaaguacuccuacaucaacaagugcagccggcuccuguccgacgaccgcaccgaggucccccagcuggugaacgccaaccaauacagccccugcgugucgaucguccccucuacggugugggaggacggggacuacuaccggaagcagcucagcccccuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacagucuauauggcgugagcgggcgcggaguguuccagaacugcaccgccgucggagugcggcagcagcgcuucguauacgacgccuaccagaaccuggucggcuacuacuccgacgacggcaacuacuacugucuucgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcguccugggccucgugaacagcucccuguucguugaggacugcaagcugccccucgggcagagccugugcgcccugcccgacaccccgagcacccucacgcccuga

SEQ ID NO: 2267 - RNA, 2244 nt, Artificial Sequence; identical to SEQ ID NO: 1661
  derived and/or modified CDS sequence (opt11) from MERS-CoV__AHC74088__S1

SEQ ID NO: 2268 - RNA, 2244 nt, Artificial Sequence; identical to SEQ ID NO: 1662
  derived and/or modified CDS sequence (opt11) from MERS-CoV__AHI48528__S1

SEQ ID NO: 2269 - RNA, 2244 nt, Artificial Sequence
  derived and/or modified CDS sequence (opt11) from MERS-CoV__AHI48550__S1
augauccacagcguauuccugcucauguuccugcugacucccaccgaguccuacgucgacguaggcccggacagcgugaaguccgccugcaucgaggucgacauccagcagacauucuucgacaagaccuggccccgccccaucgacgugagcaaggcggacgggaucaucuauccccagggccggaccuacagcaacaucaccaucacguaccagggccuguucccguaccagggagaccacggggacauguacguguacagcgcgggccaugccaccggcaccacgccccagaagcuguucgucgccaacuacucccaggacgugaaacaauucgccaacggauuugugguccgcaucggcgcagcggccaacagcaccgggaccgugaucauaucccccagcaccuccgcaaccauccggaagaucuaccccgccuucaugcuugguagcagcguggggaauuuuagugacggcaagaugggccgcuucuucaaccacacgcucguccugcugccggacgggugcggcacccuccuacgggcguucuauugcauucuggagccccgcuccgggaaccacugccccgccggcaacagcuacacauccuucgcuaccuaccacacucccgccaccgacuguagcgacggcaacuacaaccgcaacgccucccucaacucauucaaggaguacuucaaccugcgcaacugcaccuucauguacaccuacaacaucacggaggacgagauccuggagugguucgggaucacccagaccgcgcagggcgugcaccucuucagcucucgguacguggaccuguacgggggcaacauguuccaguucgcaacccugccggucuacgacacgaucaaguacuacagcaucauaccgcacuccauccgcagcauucaguccgaccggaaggccugggccgccuucuacguguacaaacuccaaccccugaccuuccugcucgacuucagcguggacggguacauccgccgggcgaucgacugcggcuucaacgaccugucccagcugcacugcagcuacgaguccuucgacgucgagagcggcguguauuccgugucguccuucgaggccaagcccagcggguccgucguagagcaagccgagggcguggagugcgacuucagcccgcuccuguccgggaccccgccucaggucuacaacuucaaacgccugguguucaccaacugcaacuacaaccucacgaagcugcugagccucuucuccgucaacgacuucacgugcagccagaucagccccgccgccaucgcgucgaacugcuacagcuccuuaauccuggacuacuucuccuauccccucuccaugaaauccgaccuguccgugagcuccgccggccccaucucccaguucaacuacaagcaguccuucagcaacccgaccugccugauacucgccaccgugccccacaaccugaccaccaucaccaagccccugaaguacuccuacaucaacaagugcucccgacucuuguccgacgaccgcaccgaagucccccagcuggugaacgccaaccaguacuccccuugcguguccaucguccccagcacgguuugggaggacggggacuacuaccggaagcagcucagcccgcuggagggcggaggguggcugguggccaguggcagcaccgucgcgaugaccgagcaguuacagaugggguucggcauaaccgugcaguacgggaccgacacgaacuccgucugccccaagcuggaguucgccaacgacacaaagaucgccagccagcugggaaacugcgucgaguacucccucuacggcguaucggggcgcggaguguuccagaacuguaccgccguuggggugcggcaacagcgcuucguguacgacgcguaccagaaccuggucggcuacuacuccgacgacggcaacuacuacugccuucgggccugcgucucagugcccgucuccgugaucuacgacaaggagaccaaaacgcacgccacccuguuugggagcgucgccugcgagcacauuuccagcaccaugagucaguacagccgcuccacacgcagcaugcucaagcggcgcgacuccacguacggcccgcugcagacccccguagggugcgugcuaggccucgugaacagcucccuguucgucgaggacugcaagcugccccucgggcagucccugugcgcccuucccgacacgccgagcacccugacgcccuga

SEQ ID NO: 2270 - RNA, 2244 nt, Artificial Sequence
  derived and/or modified CDS sequence (opt11) from MERS-CoV__AHI48583__S1
augauccacagcguguuucugcucauguuccugcugacccccaccgaguccuacgucgacgugggcccggacagcgugaaguccgccugcaucgaggucgacauccagcagacguucuucgacaagaccuggccccgccccaucgacguguucaaggccgacgggaucaucuacccccagggccggaccuacagcaacaucaccaucacguaccagggccucuucccguaccagggcgaccacggagauauguacguguacuccgcgggccacgccaccggcaccacgccccagaagcuguucgucgccaacuacagccaggacgugaagcaguucgccaacgguuucguggucaggaucggcgccgcggccaacuccaccgggaccgugaucaucagccccucgaccagcgccaccaucagaaagaucuaccccgccuucaugcugggguccagcguggguaacuucuccgacggcaagaugggccgcuucuucaaccacacgcucguucugcugccggacgggugcggaacccuccugcgggcguucuacugcauccuggagccccgcagcgggaaccacugccccgccggcaacuccuacaccagcuucgccacuuaccacacgcccgccaccgacugcuccgacggcaacuacaaccggaacgccagccucaacuccuucaaggaguacuucaaccugcgcaacugcaccuuuauguacaccuacaacaucaccgaggacgagauccuggagugguucgggaucacccagaccgcgcagggcgugcaccucuucagcagccgguauguggaccuguacggggguaacauguuccaguucgccacccugccagucuacgacacgaucaaguacuacuccaucaucccccacagcauccgcuccauccagagcgaccggaaggccugggcggccuucuacguguacaagcuccagccccugaccuuccugcucgacuucucgguggauggguacauccgccgggcgaucgacuguggcuucaacgaccugagccagcugcacugcuccuacgagagcuucgacgucgaguccggcguguauagcguguccagcuuugaggccaagcccuccgggagcgucguggagcaggcagagggcguggagugcgacuucuccccgcuccugagcgggaccccgccccaggucuacaacuucaagcgccugguguucaccaacugcaacuacaaccucacgaagcugcugucccucuucagcgucaacgacuucacgugcucccagaucagccccgccgccaucgcgucgaacugcuacuccagccugauccuggacuacuucuccuacccccucagcaugaaguccgaccugagcguguccagcgccgggcccaucucccaguucaacuacaagcagucauucuccaacccgaccugccugauccucgccacggugccccacaaccugaccaccaucaccaagccccugaaguacagcuacauuaacaagugcucccggcuccugagcgacgaccgcaccgaggucccccagcuggugaacgccaaccaguacucucccugcgugagcaucguccccaguacggugugggaggacggggacuacuaccggaagcagcucagcccacucgagggcggcggguggcugguggccucgggcuccaccgucgcgaugaccgaacagcuccagaugggguucggcaucaccgugcaguacgggaccgauacgaacagcgugugccccaagcuggaguucgccaacgacaccaagaucgccucccagcugggcaacugcguagaguauagccucuacggcguguccgggcgcggcguguuccagaacugcaccgccgucggggugcggcagcagcgcuucguguacgacgcauaccagaaccuggucggcuacuacagcgacgacggcaacuacuacugccuuagggccugcguguccgugcccgucagcgugaucuacgacaaggagaccaagacucacgccacccuguucggguccguggccugcgagcacaucagcuccaccaugagccaguacucccgcagcacccgcuccaugcucaagcggcgcgacagcacguacggaccccugcagaccccugucgggugcgugcugggccucgugaacuccagccuguucgucgaggacugcaagcugccccucgggcagagucugugcgcccugcccgacaccccgagcacccucacucccuga

SEQ ID NO: 2271 - RNA, 2244 nt, Artificial Sequence
  derived and/or modified CDS sequence (opt11) from MERS-CoV__AHI48605__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguaagcaaggccgacgggaucaucuacccccagggccggaccuacuccaacaucacgaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcugccaacagcaccgggaccgugaucaucucccccagcaccuccgcuaccauccggaagaucuaccccgccuucaugcugggcagcuccguggggaacuucucugacggcaagaugggccgcuucuucaaccacacgcucguccugcugccggacggguguggcacucuccugcgggcguucuacuguauccuggagccccgcuccgggaaccacugccccgccggcaacagcuacaccuccuucgccaccuaccacacgcccgccaccgacugcagcgacggcaacuacaaccggaacgccucccucaacuccuucaaggaguacuucaaccugcgcaacugcaccuucauguacaccuacaacauaacggaggacgagauccuggagugguucgggaucacccagacggcgcagggcgugcaccucuucuccucccgguacguggaccuguacgggggcaacauguuccaguucgccacccugccggucuacgacacgauuaaguacuacagcaucaucccccacuccauccgcagcauccaguccgaccggaaggccugggccgccuucuacguguacaagcuccaaccucugacguuccugcucgacuucagcguggacggguacauccgacgggcgaucgacugcggcuucaacgaccuaucccagcugcacugcagcuacgaguccuucgacguagaaucaggcguguacuccgugagcuccuucgaggccaagcccagugggagugucguggagcaggccgagggcguggagugcgacuucagcccgcuccuguccgggaccccgccccaggucuacaacuucaagcgccuggucuucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggccgaucagccaguucaacuacaagcaguccuucagcaacccgaccugccugauccucgcaaccgugccccacaaccugaccaccaucaccaagccccugaaguacuccuauaucaacaagugcagccggcuccuguccgacgaucgcaccgaggucccccagcuggugaacgccaaccaguacagccccugcguguccaucguccccagcacggugugggaagacggggacuauuaccggaagcagcucagcccgcuggaaggcggcggguggcugguggccuccggcagcaccgucgcgaugaccgagcagcuccagaugggcuucggcaucaccgugcaguacgggaccgauacgaacuccguaugccccaagcuggaguucgccaacgacacuaagaucgccagccagcugggcaacugcguagaguacucccucuacggcgugagcgggagaggcguguuccagaacugcaccgccgucggggugcggcagcagcgcuuuguguacgacgcguaccagaaccuggucggcuacuacuccgacgacggcaacuacuacugccugcgggccugcgugagcgugcccgucuccgugaucuacgacaaggagaccaagacgcacgccacccuguucgggucuguggcaugcgagcacauauccagcaccaugucccaguacagccgcucaacccgcucgaugcucaagcggcgcgacuccacguacggcccgcuucagacccccgucgggugcgugcugggccucgugaacagcucccuguucgucgaggacugcaagcugccccucggccagagccugugcgcccugcccgacaccccgagcacccucacgcccuga

SEQ ID NO: 2272 - RNA, 2244 nt, Artificial Sequence
  derived and/or modified CDS sequence (opt11) from MERS-CoV__AHY21469__S1
augauccacagcguguucuuacucauguuccugcugacccccaccgaauccuacgucgacgucggcccggacagcgugaaguccgccugcaucgaggucgacauucagcagacuuucuuugauaagaccuggccucgcccaauagacgugaguaaggccgacgggaucaucuacccccagggccggaccuauuccaacaucacuaucacguaccagggccucuuccccuaccagggcgaccauggggacauguacguguacagcgcggggcacgccaccgucaccacgccccagaaacucuucgucgccaacuauucacaggaugugaagcaguucgccaacggcuucgucgugcgcaucggcgccgcggccaacagcaccgggaccgucaucaucucccccagcaccagcgccaccauacggaagauuuaccccgcuuucaugcugggaucguccgugggcaacuucagcgacgggaagaugggccgcuucuucaaccacacguuagugcugcugccggacggcugcgggacccuucugcgggcauucuacugcauccuggagccccgcucgggcaacuacugccccgccgggaacucauacaccuccuucgccaccuaccacacgcccgcaaccgacuguagcgacggcaacuacaaccggaacgccucccucaacagcuucaaggaguacuucaaucugcgcaacugcaccuucauguauaccuacaacaucacggaggacgagauccuggagugguucggcaucacccagaccgcccagggggugcaccucuuuagcuccagauacgucgaccuguacggcggaaacauguuccaguucgccaccuugccggucuacgacacgaucaaguacuacagcaucaucccccacagcauccucagcauccagucggaccgcaaggccugggcggccuuuuacgucuacaagcugcagccccugacguuccuccuggacuucagcgucgacggcuacauccgcagagcgauugacugcggguucaaugaccugucccaguugcacugcagcuacgaguccuucgacgucgagagcggcguguacuccgugagcuccuucgaggccaagcccagcggcucggugguggagcaggccgagggggucgagugcgacuuuagcccgcugcuguccgguaccccgccccagguuuauaacuucaagcggcucgucuucaccaauugcaacuacaaccugacaaagcugcucagccuguuuuccgugaacgacuucacgugcagccagauuagccccgccgccaucgcgucuaacuguuacagcucccugauccucgacuacuucagcuauccucuguccaugaaguccgaccugagcgugucuucugccgggcccauuagccaguucaacuacaagcaguccuucucgaacccgaccugccucaucuuagccaccgucccccacaaccugaccaccaucacuaagccgcuuaaguacucuuacaucaacaagugcucgcgccuguuguccgacgacaggaccgaagugccccaacucgugaacgccaaccaguacagccccugcgucuccaucguccccagcacggugugggaggacggugauuacuaccgcaagcagcugagcccgcuggaaggcgggggcuggcucgucgcauccgggagcaccguggcgaugaccgagcagcugcagaugggcuucggaaucacugugcaguacgguaccgacaccaacuccgucugcccaaagcucgaguucgccaacgacaccaagaucgccagccagcucgggaacugcguggaguacucccuuuacggcgugagcggcagaggggucuuccagaauugcaccgccgugggcgugcggcagcagagguucgucuaugacgcguaccagaaccuggugggcuauuacuccgacgacggcaacuacuacugccugcgcgcuugcguaaguguccccguguccgucauuuacgacaaggagaccaagacacaugccacccucuucggcagcguugccugcgagcacaucuccagcaccaugucccaguacucgcgguccacccgcagcauguuaaagcgccgugacuccacuuacgggccccugcagacccccgugggaugcguguuagggcuggugaacagcucccuguucguggaggacugcaaacucccccugggccagagcuuaugcgcccuccccgacaccccaagcacccuaacgcccuag

SEQ ID NO: 2273 - RNA, 2244 nt, Artificial Sequence
  derived and/or modified CDS sequence (opt11) from MERS-CoV__AHZ64057__S1
augauccauagcguguuccugcucauguuccugcugacccccaccgaguccuacgucgacgugggcccggacagcgugaaguccgccuguaucgaggucgacauccagcagacguucuucgacaagaccuggccccgccccaucgacgugagcaaggccgacgggaucaucuacccccagggccguaccuacuccaacaucaccaucacauaccagggccucuucccguaccagggcgaccacggggacauguacguguacagcgcgggccacgccaccggcaccacgccccagaaacuguucgucgccaauuacucccaggacgugaagcaguucgccaacggguucguaguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacacucguccugcugccggacgggugcgguacccuccugcgggcguucuacugcauccuggagccccgcuccgggaaccacugccccgccggcaacagcuacaccuccuucgccaccuaccacacgcccgccaccgacugcagcgacggcaacuauaaucggaacgccucccucaauagcuucaaagaguacuucaaccugcgcaacugcaccuucauguacaccuacaacaucacggaggacgagauccuggagugguucgggaucacccagaccgcgcagggcgugcaccucuucagcucccgguacguggaccuguaugggggcaacauguuccaguucgccacccugccggucuacgacacgauuaaguacuacagcaucaucccccacuccauccgcaguauccaguccgaccggaaggccugggccgccuucuacguguacaagcuccagccgcugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagccaagcggguccgucguggagcaggccgagggcguggagugcgacuucagcccgcuccuguccgggaccccgccccaggucuacaacuucaagcgccugguguucaccaacugcaacuacaaccucacgaagcuacugagccucuucuccgucaacgacuucacgugcagccagaucucacccgccgccaucgcguccaauugcuacagcuccuuaauccuggacuacuucucauacccccucuccaugaaguccgaccugagcgugagcuccgccgggcccauaucgcaguucaacuacaagcaguccuucucuaacccgaccugccugauccucgccaccgugccccacaaccugaccacaaucaccaagccccugaaguacuccuacaucaacaagugcagccggcuccucuccgacgaccgcaccgaggucccccagcuggucaacgcgaaccaguacagccccugcguguccaucguccccagcaccgugugggaggacggggacuacuaccggaagcagcucucaccgcuggaaggcggcggguggcugguggccuccggcagcaccgucgcgaugacugagcagcuccagaugggauucggcauuaccgugcaauacgggaccgacacgaacuccgugugccccaagcuggaguucgccaacgacaccaagauagccagccagcucggcaacugcguggaguacucucucuacggcgugagcgggcgcggcguuuuccagaacugcaccgccgucggggugcggcagcagcgcuucguguacgacgcguaucaaaaccuggucggcuacuacuccgacgacggcaacuacuacugccugcgggccugcgugagcgugccggucuccguaaucuacgacaaggaaaccaagacgcacgccacccuguucgggagcguggccugcgagcacaucuucuccaccaugagccaguacagucgcagcaccagguccaugcucaagcgucgugacagcacguacggcccgcugcagacccccgucgggugcgugcugggccucgugaacuccagccuguucgucgaggacuguaagcucccccucgggcagucccugugcgcccugcccgacaccccaagcacgcucacgcccuga

SEQ ID NO: 2274 - RNA, 2244 nt, Artificial Sequence; identical to SEQ ID NO: 1650
  derived and/or modified CDS sequence (opt11) from MERS-CoV__AID50418__S1

SEQ ID NO: 2275 - RNA, 2244 nt, Artificial Sequence; identical to SEQ ID NO: 1650
  derived and/or modified CDS sequence (opt11) from MERS-CoV__AID55068__S1

SEQ ID NO: 2276 - RNA, 2244 nt, Artificial Sequence; identical to SEQ ID NO: 1670
  derived and/or modified CDS sequence (opt11) from MERS-CoV__AID55073__S1

SEQ ID NO: 2277 - RNA, 2244 nt, Artificial Sequence
  derived and/or modified CDS sequence (opt11) from MERS-CoV__AIY60528__S1
augauacacagcguguuccugcucauguuccugcugacccccaccgaguccuacgucgacgugggcccggacagcuucaaauccgccugcaucgagguggacauucagcagacguucuucgacaaaaccuggccacgccccaucgaugucagcaaggcugacgggaucaucuacccccagggccggaccuacuccaacaucaccaucacguaccagggccucuucccguaccagggcgaccacggggacauguacguguacagcgcgggccacgccaccggcaccacgccccaaaagcuguucguggccaacuacucccagaacgucaagcaguucgccaacggguucguggugcgcaucggcgccgcggccaacagcaccgggaccguuaucaucucccccagcaccuccgccaccauccggaagaucuaccccgccuucaugcugggcagcuccguggggaacuucagcgacggcaagaugggccgcuucuucaaccacacgcucgugcugcugcccgacgggugcggcacccuccugcgggcguuuuacugcauccuggagccccgcuccgggaaccacugccccgccggcaacagcuacaccuccuucgccaccuaccauacgcccgcgaccgacugcagcgacggcaacuacaaccggaacgccucccucaacagcuucaaggaguacuucaaccugcgcaacugcaccuucauguacaccuacaauaucacggaggacgagauccuggagugguucgggauuacccagaccgcgcagggcguccaccucuucagcucccgguacguggaccuguacgggggcaacauguuccaguucgccacccugccgguguaugacacgaucaaguacuacagcaucaucccccacuccauccgcagcauccaguccgaccggaaggccugggccgccuucuacgucuacaagcuccagccccugaccuuccugcucgacuucagcguggacggguacaucaggcgggcgaucgacugcggcuucaacgaccugucccagcugcacugcagcuacgaguccuuugacguugagagcggugucuacuccgugagcuccuucgaggccaagcccagcggguccgucguugagcaagccgagggcguggagugcgacuucagcccgcuccuguccgggaccccgccccagguguacaacuucaagcgccuggucuucaccaacugcaacuacaaccucacgaagcuguugagccucuucuccgugaacgacuucacgugcagccagaucagccccgccgccaucgcguccaacugcuacagcucccugauccuggacuacuucagcuacccgcucuccaugaaguccgaccugagcgucagcuccgccgggcccaucagccaguucaacuacaagcaguccuucagcaacccgaccugccugauccucgccacggugccccacaaccugaccaccaucaccaagccccugaaguauuccuacaucaacaagugcagccggcuccugucggacgaccgcaccgaggugccccaguuggucaacgcaaaccaguacagccccugcguguccaucgugcccagcacggucugggaggacggggacuacuaucggaagcagcucagcccgcuggagggcggcggauggcugguggccuccggcagcaccguggcgaugaccgagcagcuccagaugggguucggcaucaccguccaguacgggacggacacgaacuccgugugccccaagcuggaguucgccaacgacaccaagaucgcaagccagcugggcaacugcguggaauacucccucuacggcgucagcgggcgcggcguguuccaaaacugcaccgccguggggguccggcagcagcgauucguguacgacgcguaccagaaccuggugggcuacuacuccgacgacggaaacuacuacugccugcgggccugcgucagcguucccguguccgucaucuacgacaaggagaccaagacgcacgccacccuguucgggucgguggccugcgagcacaucucaagcaccaugucccaguacagccgcuccacccgcagcaugcucaagcggcgcgacuccacguacggcccgcugcagaccccaguagggugcguccugggccucgugaacagcucccuguucguggaggacugcaagcugccccucgggcagagccugugcgcccugcccgacaccccaagcacccucacucccuga

SEQ ID NO: 2278 - RNA, 2244 nt, Artificial Sequence
  derived and/or modified CDS sequence (opt11) from MERS-CoV__AIY60558__S1
augauccacagcguguuccuccucauguuccugcugacccccaccgaguccuacgucgacgucggaccggacagcuucaaauccgccugcauagagguggacauccagcagacuuucuucgacaagaccuggccccgucccaucgacgucagcaaggccgacgggauaaucuacccccaggguagaaccuacuccaacaucaccaucacguaucagggacucuucccguaccagggcgaccacggggacauguacguguacucugcgggccacgccaccggcaccacgccccagaaacuuuucguggccaacuacucccaggacgugaagcaguucgccaacggauucguggugcgcaucggcgcggcggcuaacagcaccgggaccgucaucaucuccccgagcaccuccgccaccauccggaagauauaccccgcguucaugcuuggaagcuccguggggaauuucagcgacggcaagaugggacgcuuuuucaaccacacgcucgugcugcugccggacgggugcggcacacuccugcgggcguucuacugcauccuggagccccgcuccgggaaccacugccccgccggaaacagcuacaccuccuucgccacuuaccacacgcccgcuaccgacugcagcgacggcaacuacaacagaaacgccucccucaacaguuuuaaggaguacuucaaccugcgcaacugcaccuucauguacaccuacaacaucacggaggacgaaauacuggagugguucggcaucacccagaccgcccagggugugcaccucuucuccucccgguacguggaccuguacgggggcaacauguuccaguucgcgacucugccggucuacgacacuauuaaguacuauagcaucaucccgcacuccauccgcagcauccaaagcgacagaaaggccugggccgccuuuuacgucuacaaacuucagccccugacguucuuacuagacuucagcgucgacggguacaucagacgggcgaucgacugcgguuucaacgaccuuucccaacugcacugcuccuaugaguccuucgauguggagaguggcgucuacuccgugagcuccuucgaggcuaagcccagcggguccgugguugagcaggccgagggcguggagugugacuucagcccgcuccuguccggaaccccgccccagguguacaacuucaagcgccuggucuucaccaacugcaacuacaaccucacgaagcugcucagccucuucuccgugaacgacuucacguguagccagaucagccccgccgccaucgcguccaacuguuacagcuccuuaauacuggacuacuucucauacccccucuccaugaaguccgaccugagcgucagcuccgccgggcccaucagccaguucaauuacaagcaguccuucagcaacccgacuugccugauccucgccacagugccacacaaccugaccacgauaacaaagccccuuaaguacuccuacaucaauaagugcagcaggcuacugagcgacgaccgcaccgaaguaccccagcugguuaacgccaaucaguacagccccugugugucaaucgugcccagcacggucugggaggacggggauuacuaccggaagcagcucagcccgcuggagggaggcgggugguuaguggccucaggcuccaccguugcgaugaccgagcagcuacagaugggguucggcaucaccguccaguauggaaccgacacgaacuccgucugucccaagcuggaguucgcaaaugacaccaagaucgccucacaguugggcaacugcguggaguacucccucuacggggucagcgggcgcggcguguuccagaacugcacggccguggggguccggcagcaacgcuucguguacgacgcguaccagaaccuggugggcuacuacuccgacgacggcaauuacuacugccugcgggccugcgucuccguccccguaucugucaucuaugacaaggagacaaagacgcacgccacccuguucgggagcgucgccugcgagcacaucuccagcaccaugucccaguacagccgcuccacacgcagcaugcucaagcggcgcgacaguacguacggcccucuacagacgccuguggggugcguccugggccucgugaacagcucccuguucguggaggacugcaagcugccccucgggcagagccugugcgcccugcccgacaccccgagcacgcucacgcccuga

SEQ ID NO: 2279 - RNA, 2244 nt, Artificial Sequence
  derived and/or modified CDS sequence (opt11) from MERS-CoV__AIZ74450__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucaccuaccagggccucuucccguaccaaggcgaucacggggacauguacguguacagcgcgggccacgccaccggcaccacgccccagaagcuguucgucgccaacuacucgcaggacgugaagcaguucgccaacggguucgugguccgcaucggcgccgcggccaacagcaccgggacugugaucaucucccccucgaccuccgccaccauccggaagaucuaccccgccuucaugcugggaagcuccguggggaacuucucagacggcaagaugggccgcuucuucaaccacacgcucguccuguugccggacgggugcggcacccuccugcgggcguucuacugcauccuggagccccguuccgggaaccacugcccggccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagacugcgcagggcgugcaccucuucagcucaagguacguggaccuguacgggggcaacauguuccaguucgccacccugccggucuacgacacgaucaaguacuacagcaucaucccccacuccauccgcagcauccaguccgaccggaaggccugggccgccuucuacguguauaagcuccagccccugaccuuccugcucgacuucagcguggacggguacauccgccgggcgaucgacugcggcuucaacgaccugucccagcuacacugcaguuacgaguccuucgacgucgagagcggcguguacuccgugagcuccuucgaggccaaacccagcggguccgucguggagcaggccgagggcguggagugcgacuucagcccgcuccuguccgggaccccgccccaggucuacaacuucaagcgccugguguucaccaacugcaacuacaaucucacgaagcugcugagccucuucuccgucaacgacuucacgugcagccagaucagccccgccgccaucgcguccaacugcuacagcucccugauccuggacuacuucagcuacccccucuccaugaagagugaccugagcgugagcuccgccgggcccaucucccaguucaacuacaagcaguccuucagcaacccgaccugccugauccucgccaccgugccccacaaccugaccaccaucaccaagccccugaaguacuccuacaucaacaagugcucgcggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcacagucgcgaugaccgagcagcuccagaugggguucggcaucaccgugcaguacgggaccgacacgaacuccguaugucccaagcuggaguucgccaacgacaccaagaucgccagccagcugggcaacugcgucgaauacucccucuacggcgugagcgggcgcggcguguuccagaacugcaccgccguagggguccggcagcagcgcuucguguacgacgcguaccagaaccuggucggcuacuauuccgacgacggcaacuacuacugccuucgggccugugugagcguccccgucuccgugaucuacgacaaggagaccaaaacgcacgccacccuauucgggagcguggccugcgagcacaucuccagcaccaugucccaguacagccgcuccacccgcagcauguugaagcggcgagacuccacguacggcccgcugcagacccccgucgggugcgugcugggccucgugaacagcucucuguucgucgaggacugcaagcugccucucgggcagagccugugcgccuuacccgacacgccgagcacccucacgcccuga

SEQ ID NO: 2280 - RNA, 2244 nt, Artificial Sequence
  derived and/or modified CDS sequence (opt11) from MERS-CoV__AJD81440__S1
augauccacagcguguuccugcucauguuccugcugacccccaccgaguccuacgucgacguuggcccggacagcgugaaguccgccugcaucgaggucgacauccagcagacguuuuucgacaagaccuggccucgccccaucgacgugagcaaagcugacgggaucaucuacccccagggccggaccuacuccaacaucaccaucacguaccagggccucuucccguaccagggcgaccacggggacauguacguauacagcgcgggccacgccacgggcacaacgccccaaaagcuguucgucgccaacuacucccaggacgugaagcaguucgccaacggguucgugguccgcaucggcgccgcggccaacagcaccgggaccgugaucaucaaccccuccaccuccgccacgauccggaagaucuaccccgccuucaugcugggcagcaguguggggaacuucagugacggcaagaugggccgcuucuucaaucacacgcucguucugcugccggacgggugcggcacccuccugcgggcguucuacugcauccuggagccccgcagcgggaaccacugccccgccggcaacuccuacaccagcuucgccaccuaccacacgcccgccaccgacugcuccgacggcaacuacaaccggaacgccagccucaauuccuucaaggaguacuucaaccugcgcaacugcaccuucauguacaccuacaacaucacggaagacgagauccuggagugguucgggaucacccagaccgcgcagggcgugcaccucuucagcagccgguacguagaccuauacggaggcaacauguuccaguucgccacccugccggucuacgacacgaucaaguacuacuccaucaucccccacagcauccgcuccauccagagcgaccggaaggccugggccgccuucuacguguacaagcuccagccccugaccuuccugcucgacuucucaguggacggguacauccgccgggcgaucgacugcggcuucaacgaccugagccagcugcacugcuccuacgagagcuucgacgucgagucaggcguguacagcguguccagcuucgaggccaagcccuccgggagcgucguagagcaggccgagggcguggagugcgacuucucgccacuccugagcgggaccccgccccagguuuacaacuuuaagcgccugguguucaccaacugcaauuacaaccucacgaagcugcugucccucuucagcgucaacgacuucacgugcucccagaucagcccugccgccaucgcaagcaacugcuacuccucucugauccuggacuacuucuccuaccccuugagcaugaaguccgaccugagcguguccagcgccgggcccauaucccaguucaacuauaagcagagcuucuccaacccgaccugccugauccucgccaccgugccccacaaccugaccaccaucacgaagccccugaaguacagcuacaucaacaagugcucccggcuccugagcgacgaccgcaccgaggucccccagcuggugaacgccaaccaguacucccccugcgugagcaucguccccuccacggugugggaggacggggacuacuaccggaagcaguugagcccgcuggaaggcggcggguggcugguugccagcggcuccaccgucgcgaugaccgaacagcuccagauggguuucggcaucacugugcaguacgggaccgacacgaacagcgugugcccgaaacuggaguucgccaacgacaccaaaaucgccucccagcugggcaacugcgucgaguacagccucuacggcguguccgggcgcggcguguuccagaauugcaccgccgucggggugcggcaacagcguuucguguacgacgcguaccagaaccuggucggcuacuacagcgacgacggcaacuacuacugccugcgggccugcguguccgugcccguaagcgugaucuacgacaaggagaccaagacgcacgccacccuguucggguccguggccugcgagcauaucagcuccacuaugagccaguacucccgcagcacccgcuccaugcucaagcggcgagacagcacguacggcccgcugcagaccccagucgggugcgugcugggccucgugaacuccagccuguucgucgaggacugcaagcugccccucgggcagucccuuugugcccugcccgacaccccgagcacccucacgcccuga

SEQ ID NO: 2281 - RNA, 2244 nt, Artificial Sequence; identical to SEQ ID NO: 1650
  derived and/or modified CDS sequence (opt11) from MERS-CoV__AKI29284__S1

SEQ ID NO: 2282 - RNA, 2244 nt, Artificial Sequence
  derived and/or modified CDS sequence (opt11) from MERS-CoV__AKL59401__S1
augauccacucaguguucuuacucauguuccuacuaacccccaccgaguccuacguggaugugggcccggacagcguuaagucugccugcaucgaggucgacauacagcaaacguucuucgacaagaccuggccccgccccaucgacguuucaaaggcggacgggaucaucuacccccagggccggaccuacuccaacaucacgaucacguaccaaggccucuucccguaucaaggggaccacggggacauguacguguacuccgcgggccacgcuaccggcaccacuccucagaagcuguucguggcaaauuacucccaggacgugaagcaguucgccaacggguucgucguucguaucggcgccgcggcuaacagcaccgggaccgugaucaucuccccuagcacccgggccaccauccgcaagauuuaucccgcauucaugcugggcuccagcgugggaaacuucuccgacggcaagaugggccgguucuucaaccacacgcucguccugcugccggaugggugcggcacccuacugcgcgcguucuacuguauccuugagccucggagcgggaaccauugccccgcuggcaauuccuacaccagcuucgccacguaccacacgccggccaccgauugcuccgacggcaacuacaaccgcaacgccagccucaacuccuucaaggaguacuucaaccugcggaacugcaccuucauguauaccuacaacaucacggaagacgaaauccuggagugguucgggaucacccagaccgcacaaggcgugcaccuguucagcagcagguacgucgaccuguacgggggaaacauguuccaguucgccacccugccagucuacgacacgauuaaguauuacuccaucauuccacacagcauccgguccauccaguccgaccgcaaggccugggccgccuucuacgucuauaagcuccaaccccugaccuuccugcucgacuuuucuguggacggguacauccggcgugcgaucgacugcggcuucaacgaccugagucagcugcacugcuccuacgagagcuuugacgucgaguccggcguguacagcguguccagcuucgaggccaagcccuccgggagcgucguggaacaggccgagggcguggagugcgacuucuccccgcuccugagcggcaccccgccccaggucuacaacuucaagcgauugguguucaccaacugcaacuacaaccucacgaagcugcugucccucuucagcguaaacgacuucacgugcucccagaucagccccgccgccaucgcgagcaacugcuacuccagccuuauccuggacuacuuuuccuacccccucagcaugaaguccgaccugagcguguccagcgccggucccauaucccaguucaacuacaagcagagcuucuccaacccgaccugccugaucuuagccaccgugccccacaaccugaccaccaucaccaagccccuaaaauacagcuacaucaacaagugcucccgccuccugagcgacgaccggaccgaagucccccagcugguaaacgccaaccaguacucccccugcgugagcauccuccccuccacaguaugggaggacggagacuacuaccgcaagcagcugagcccgcuggagggcggcggauggcuuguggccagcggcuccaccguggcuaugaccgagcagcuucaaaugggguucggcaucaccguccaguacgggaccgacacaaacagcgugugcccgaagcuggaguucgccaacgacaccaagaucgcgucccagcucgguaacugcguggaguacagccuguacggcguauccggcaggggcguguuucagaacugcaccgcgguggggguccgucagcaacgguucguuuacgacgcuuaccagaaccuggugggcuacuacagcgaugaugggaacuacuacugccugcgcgccugcguguccguccccgugagcgucaucuacgacaaggagaccaagacgcacgccaccuuguucgggaguguggccugcgagcacauaucauccaccaugagccaguacucccgcagcacucgguccaugcugaagaggcgggacagcacauacggcccgcuacagacccccguggguugcgucuuaggccuggucaacagcagccuguucguggaggacugcaagcugccccugggucagucccugugcgcccuccccgacaccccgagcacgcugacgcccuga

SEQ ID NO: 2283 - RNA, 2244 nt, Artificial Sequence
  derived and/or modified CDS sequence (opt11) from MERS-CoV__AKM76229__S1
augauccacagcguauuccugcucauguuucugcugacccccaccgaguccuacgucgacguaggcccggacagcgugaaguccgccugcaucgaggucgacauccagcagacguucuucgacaagaccuggccccgccccaucgacgugagcaaagccgacgggaucauauacccccagggccgaaccuacuccaacaucaccaucacguaccagggccucuucccguaccaaggcgaccauggggauauguacguguauagcgcgggccacgccaccggcaccacaccccagaaacuguucguggccaacuacucccaggacgugaagcaguucgccaacggguucgugguccguauaggggccgcggccaacucuaccgggaccgugaucaucucccccagcaccuccgccacuauccggaagaucuaccccgccuucaugcugggaagcuccguggggaacuucagcgacggcaagaugggacgcuucuucaaccacacgcucguccugcugccggaugggugcggcacccuccugcgggcguucuacugcauccuggagccccgcuccgggaaccacugccccgcuggcaacagcuacaccuccuucgccaccuaccacacgcccgccaccgacugcagcgacggcaauuacaaucggaacgccucccucaacagcuucaaggaguacuucaaccugcgcaacuguaccuucauguauaccuacaacaucacggaggacgagauucuggagugguuugggaucacccagaccgcgcagggcguucaucucuuuagcuccagguauguggaccuguacgggggcaacauguuccaguucgccacccugccggucuacgacacgaucaaguacuacagcaucaucccccacuccauccgcagcauccaguccgaccggaaggccugggcagccuucuacguuuacaagcuccagccccugaccuuccuacucgacuucagcguugacggguacauccgccgggcgaucgacugcggcuucaacgaccugucccagcugcacugcagcuacgagagcuucgaugucgagagcggcguuuacuccgugagcuccuucgaggcaaagcccagcggauccgucguggagcaggccgagggcguggagugcgacuucagcccccuacuguccgggacuccgccccaggucuacaacuucaagcgccugguguuuaccaacugcaacuacaaccucacgaaguugcugagccucuucuccgucaacgacuucacgugcagccagaucagccccgcggccaucgcguccaacuguuacagcucccugaucuuagacuacuucagcuacccccucucgaugaagucagaccugagcgugagcuccgccgggccuaucagccaguucaacuacaagcaguccuucagcaauccaaccugccugauccucgccaccgugccccacaaccugaccaccaucaccaagccucugaaguacuccuauauuaacaagugcagccggcuccuguccgacgaucgcaccgaggucccccagcugguuaacgccaaccaguacagccccugcguguccaucguccccagcacugugugggaagacggggacuacuaccggaagcagcucagcccgcuggagggcggcggguggcugguggccuccgggagcaccgucgcgaugaccgagcagcuucagauggguuucggcaucaccguccaguacgggacugacacgaacuccgugugccccaagcuggaguucgcaaacgacaccaagaucgccucgcaacugggcaacugcgucgaguacucccuuuauggcgugagcgggcgcggcguguuccagaacugcaccgccgucggggugaggcagcagcgcuucguguacgacgcguaccagaaccuggucggcuacuacuccgacgacggcaacuacuacugccugagagccugcgugagcguucccgucuccgugaucuacgacaaggagaccaagacgcacgccacccuuuucgggagcguggccugcgaacacaucucuagcaccaugucccaguacucucgcucaacccgcaguaugcuaaagcggcgugacuccacguacggcccgcugcagacucccgucgggugcgugcugggccucgugaacuccucccuguucgucgaggacugcaagcugccguuggggcagagccugugcgccuuacccgacaccccgagcccccucacgccuuga

SEQ ID NO: 2284 - RNA, 2244 nt, Artificial Sequence
  derived and/or modified CDS sequence (opt11) from MERS-CoV__AKM76239__S1
augauccacagcguauuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgauggcaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccuucgggcguucuacugcauccuggagccccgcuccgggaaccacugccccgccggcaacagcuacaccuccuucgccaccuaccacacgcccgccaccgacugcagcgacggcaacuacaaccggaacgccucccucaacuccuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguauuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugucauccuucgaggccaagcccagcggguccgucguggagcaggccgaagguguggagugcgacuucagcccgcuccuguccgggaccccgccucaggucuacaacuucaagcgccugguguucaccaacugcaacuacaaccucacuaagcugcugagccucuucuccgucaacgacuucacgugcagccagaucagccccgccgccaucgcguccaauugcuacagcucccuuauccuggacuauuucagcuacccccucuccaugaaguccgaccugagcgugagcuccgccggacccaucagccaguucaacuacaagcaauccuucagcaacccgaccugccugauccucgccaccgugccccacaaccugaccaccaucaccaagccccugaaguacagcuacaucaacaagugcagccggcuccuguccgacgaccgcaccgagcugccccagcucguuaacgccaaccaguacagccccugcguguccaucgugcccagcacggucugggaggacggggacuacuaccggaagcagcugagcccguuggagggcggcggguggcucguggccuccggcagcaccguggcgaugaccgagcagcugcagaugggguucggcaucaccgugcaguacgggaccgacacgaacuccgugugccccaagcuggaguucgcaaacgacaccaagaucgccagccagcucggcaacugcguggaguacagccuguacggcgucagcgggcgcggcguguuccagaacugcaccgccguugggguccggcagcagcgguuuguguacgacgcguaccagaaccuggugggcuacuacuccgacgacggcaacuacuacugucugcgagccugcgucagcgugcccguguccgucaucuacgacaaggagaccaagacgcacgccacccucuucgggagcguggccugcgagcacaucuccagcaccaugucccaguacagccgcuccacccgcagcaugcugaagcggcgcgacuccacguacggcccgcugcagacccccguggguugcgugcucggccuggugaacagcucccuguucguagaggacugcaagcucccccuggggcagagccugugcgcccuccccgacaccccgagcacccugacgcccuga

SEQ ID NO: 2285 - RNA, 2244 nt, Artificial Sequence; identical to SEQ ID NO: 1679
  derived and/or modified CDS sequence (opt11) from MERS-CoV__AKN11072__S1

SEQ ID NO: 2286 - RNA, 2244 nt, Artificial Sequence
  derived and/or modified CDS sequence (opt11) from MERS-CoV__AKN11074__S1
augauacacagcguguuccugcuuauguuccugcugacccccacggaguccuacgucgacgucggcccggacagcgugaagucggccugcaucgaggucgacauccagcagacguucuucgacaaaaccuggccaagacccaucgacgugagcaaggccgacgguaucaucuacccccagggccggaccuacuccaacaucaccaucaccuaccagggcuuguuuccguaccagggcgaccauggggacauguacguauacagcgccggccacgcgaccggcaccacgccccagaagcuguucguugcuaacuauucccaagaugucaagcaguuugccaaugguuucguggugcgcaucggcgccgcugcuaacagcaccgggaccgugaucauuucccccucaacauccgcuaccauccggaagaucuaccccgcauucaugcugggcagcuccguggggaacuucagcgacggcaagaugggacgcuucuucaaccacacgcuaguccugcugccggacgggugcggaacacuccugcgagcauucuacugcauccuagagccccgcucagggaaccacugccccgccggcaacucauacaccagcuuugcgaccuaccauacuccugccaccgacugcagcgacggaaacuacaaccgcaacgccucgcucaacagcuucaaggaauacuucaaccugcgaaacugcaccuucauguacaccuacaacaucacugaggacgaaauucuggagugguuugggaucacccagacugcgcagggcguacaccucuucucaagucgguacgucgaucuguacgggggcaacauguuucaguucgccacccugccggucuacgacacgaucaaguacuacucgaucaucccgcacuccauacgcagcauacaauccgaccggaaggccugggcugccuucuacguguacaagcuccaaccccuaacauucuugcucgacuucucuguggacggauacauccgccgggcgaucgauuguggcuuuaacgacuugucccaauuacacuguuccuacgaauccuucgaugucgaaagcggcgucuacuccguguccuccuucgaagcgaaacccagcggguccgucguggagcaggccgaaggcguggaaugcgacuucagcccgcuccuguccggcaccccuccccaggucuauaacuucaagcgccugguguucaccaauugcaauuacaaccucacuaaacugcugagccucuucagugugaacgacuucacgugcagccaaaucagccccgccgccauagcaucgaacugcuacagcucacugauccuggacuacuucagcuacccccucuccaugaaguccgaccucuccgugucaagcgccggccccaucagucaguucaacuauaagcaguccuucucaaacccuaccugucugauuuuagccaccgugccacauaaucugaccaccaucaccaagccccugaaguauagcuacaucaacaaaugcagccggcuccugucugacgaccgcaccgagguuccccagcuugucaaugccaaccaguauagcccuugcguuaguacaguucccagcaccgugugggaagacggggacuacuacagaaagcagcucagcccguuagaaggcgguggguggcugguggccuccggcuccaccgucgcuaugacagagcagcuccagaugggguuuggcaucaccgugcaguauggaacagacaccaacucagugugcccuaagcuggaguucgccaacgacaccaagaucgccagccaacucggcaauugcguagaauacucccucuauggcgugagcggucgcggcguguuccaaaacugcaccgcggucggggugcggcagcagcacuuuguguacgacgcguaccagaaccuugugggauacuacucggaugaugggaacuacuacugccucagggccugcgugagcgugcccguuuccgugaucuacgauaaagagacaaagacccacgccacgcuguucggaagcguggccugugagcacaucuccagcaccaugucccaguacucucguucgacacgcagcaugcuuaagcggagagacuccacuuacggcccgcuacaaaccccagucgggugcgugcuuggccucgugaacagcucccuguucgucgaagacugcaagcugccccucgggcagucgcugugcgcccugccagacacccccagcacgcugacgcccuga

SEQ ID NO: 2287 - RNA, 2244 nt, Artificial Sequence
  derived and/or modified CDS sequence (opt11) from MERS-CoV__AKN24803__S1
auggugcacagcgucuuccucuuaauguuccuccugacacccaccgaguccuacguagacgugggccccgacagcgucaaguccgcgugcaucgagguggacauccagcagacguucuucgacaagaccuggccccgccccauagacgugagcaaggccgacgggaucaucuacccccaggggcggaccuacuccaacaucaccaucacguaccagggccucuucccguaccagggcgaucacggggacauguacgucuacagcgcgggccacgccacaggcaccacgccccagaagcuguucguggccaacuacucgcaggacgugaagcaauucgccaacggguucgucgugcgcaucggcgcggcggccaauagcaccgggaccgugaucaucucccccuccaccuccgccaccauccggaagaucuaccccgccuucaugcugggcagcuccgucgggaacuucagcgauggcaagaugggcagauucuucaaccacacgcucgugcugcugccggacgggugcggcacgcuccugcgggcguucuauugcaucuuggagccucgcuccgggaaccacugccccgccggcaacagcuacaccaguuucgcaaccuaccauacgcccgccacggacugcagcgacggcaacuacaaccggaacgccucccucaacagcuucaaggaguauuucaaccugcgcaacugcaccuucauguauaccuacaacaucacggaggacgagauccuggagugguucgggauuacccagaccgcgcagggcgugcaccucuucagcucccgguacgucgaccuguaugggggcaacauguuccaguucgccacccuaccgguguacgacacgaucaaguacuacagcaucaucccucacuccauccgcagcauccaguccgaccggaaagccugggccgccuucuacguguacaagcuccaaccccuuaccuuccugcucgacuucagcguagacggguacauccgccgggcgaucgacugcggcuucaacgaccuuucccagcugcacugcuccuacgaguccuucgacguggagagcggcguguacuccgucagcuccuucgaggccaagccuagcggguccguaguggaacaggcagagggcguugagugugacuucucaccgcuccuguccgggaccccgccccagguguacaacuucaagcgcuuagucuucaccaacugcaacuacaacuuuacgaagcuccugucacuguucuccgugaacgacuucacgugcagccagaucagccccgccgcaaucgcgucuaacugcuauagcucacucauccuggacuacuucagcuacccccuguccaugaaguccgaucucagcgugagcuccgccgggcccaucagccaauucaacuacaagcaguccuucagcaacccgacaugccugauccuggccaccgucccccacaaccucaccaccauuaccaagccucugaaguacuccuacaucaacaagugcagccggcugcucuccgacgaccgaacagaggugccccagcuggugaacgcuaaccaguacagcccgugcguguccaucgugcccuccacggugugggaagacggggacuacuaccggaagcagcugagcccgcucgagggcggaggguggcuggucgccuccggcagcaccguggcgaugaccgagcagcugcagaugggguucggcaucaccgugcaguacgggaccgacacgaacuccgucagcccaaagcucgaguucgcuaacgacaccaagaucgccucccagcugggcaacuguguggaguacagccuguacggcguguccgggcgcggcgucuuucaaaauugcaccgccguaggggugcggcagcagcgcuucgucuaugacgcguaccagaaccucgugggcuacuacagcgacgacggcaacuacuacugcuugcgggccugcguguccguccccgugagcgugauauacgacaaggagaccaagacgcacgccacccuguucggguccgucgcuugcgagcacaucagcuccaccaugagccaguauucucgcagcacccgcuccaugcugaagcggcgcgauucaacguacggcccgcuccagacccccgugggaugugugcugggccuggucaacuccagccucuucguggaggacugcaagcucccccugggucagagccugugcgcccugcccgacaccccguccacccugacgcccuga

SEQ ID NO: 2288 - RNA, 2244 nt, Artificial Sequence
  derived and/or modified CDS sequence (opt11) from MERS-CoV__AKN24812__S1
augauccacagcguguuccugcucauguuccugcugacgcccaccgaguccuacgucgacgugggcccggacucugugaaguccgccugcaucgagguugacauccagcagacguucuucgacaagacguggccccgccccaucgacgugagcaaggccgacgggaucauauacccccagggccgaaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaauuugcgaacggguucguuguccguaucggcgccgcggccaacagcaccgggaccguaauuaucucccccagcaccuccgcaaccauucggaagaucuaccccgcuuucauguuaggcagcuccguggggaacuuuagcgacggcaagaugggccgcuucuucaaccacacucucguccugcugccggacgggugcggaacccuccugcgggcguucuauugcauacuggagccccguuccgggaaccacugccccgccggcaacagcuacacuuccuucgcaaccuaccacacgccggccaccgacugcagcgacggcaacuacaaccggaacgccucccucaacagcuucaaagaguacuuuaaccugcgcaacugcaccuucauguacaccuacaacaucacggaggacgagauccuggagugguucgggaucacccaaaccgcgcagggcgugcaccucuucagcucccgguacguggaccuguacgggggcaacauguuccaauucgccacccugccggucuacgacacuaucaaguacuacagcaucaucccccauuccauccgcagcauccaguccgaccggaaggccugggccgccuucugcguguacaagcuccagccccugaccuuccugcucgacuucucuguggacggguauauccgccgggcgaucgacugcggcuucaaugaccugucccagcugcacugcaguuacgaguccuucgacgucgagagcggcguguauuccgugagcuccuucgaggccaagcccagcgggagcgucguggagcaggccgagggcguggagugcgacuucuccccgcuccuguccgggaccccgccccagguguacaacuucaagcgccugguguucaccaacugcaauuacaacuuuacuaagcuccugagccuguucucagucaacgacuucacgugcagccagaucagccccgccgcaauugcguccaacugcuacagcucccucauccuugacuacuucagcuauccccuguccaugaaaagcgaccugagcguuagcuccgccgggcccaucagccaguucaacuacaagcaguccuuuagcaauccgaccugccuuauccuggccacugugccccacaaccucaccaccaucaccaagccacugaaguacuccuacaucaacaagugcagccggcugcucuccgacgaccgcaccgaggucccccagcuagugaacgccaaccaguacagccccugcguguccaucguucccagcacggugugggaggacggggacuacuaccggaagcagcugaguccgcucgagggcggcgguuggcugguggccucgggcagcaccgucgcgaugaccgagcagcugcaaaugggguucggcaucaccgugcaguacgggaccgacacgaacagcgugugcccgaagcucgaguucgccaacgacacuaagaucgccagucagcugggcaacugcgucgaguacucccuguacggcgugagcgggcgcggcguguuccaaaacugcaccgccgucggggugcgucagcagcgcuucguguacgacgcguaccaaaaccucgucggcuauuacuccgacgacggcaauuacuacugcuugcgggccugcgugagcgugcccgucuccguaauuuaugacaaggagaccaagacgcacgccacacuguucgggagcguggccugugagcacaucuccagcaccaugucccaguacucgcgcuccacccgcagcaugcugaagcggcgugacuccacguacgggccgcuccagacccccgucgggugcgugcugggccuggugaacagcucccucuucgucgaagacugcaagcugccccuggggcagagccucugcgcccugcccgacacuccgagcacccugacgccguga

SEQ ID NO: 2289 - RNA, 2244 nt, Artificial Sequence
  derived and/or modified CDS sequence (opt11) from MERS-CoV__AKN24830__S1
augauccacagcgucuuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgccaacuacucccaggacgugaagcaguucgccaacggguucgugguccgcaucggagccgcggccaacucuaccgggaccguaaucaucucccccagcaccuccgccaccauccggaagaucuaccccgccuucaugcugggcagcuccguggggaacuucagcgacggcaagaugggccgcuucuucaaccacacgcucguccuucugccggacgggugcggcacccuccuucgggcguucuacugcauccuggagccccgcuccgggaaccacugccccgccggcaacagcuacaccuccuucgcuaccuaccacacgcccgccaccgacugcagcgacggcaacuacaaccggaacgccucccucaacagcuucaaggaguacuucaaccugcggaacugcacauucauguacaccuacaacaucacggaggacgagauccuggagugguucgggaucacccagaccgcgcagggcgugcaucucuucagcuccagauacguggaccuguacgggggcaacauguuccaguucgccacccugccggucuacgacacgaucaaauacuacagcaucaucccccacuccauccgcagcauccaguccgaccggaaggccugggccgccuuuuacguguacaagcuccagccccugaccuuucugcucgacuucucaguggacggguacauccgccgggcgaucgacugcggcuucaacgaccugucccagcugcacugcagcuacgaauccuucgacgucgagagcggcguguacuccgugagcuccuucgaggccaagcccagcggguccgucguggagcaggccgagggcguggagugcgacuucucuccgcuccuguccgggaccccgccccaagucuacaacuucaagcgccugguguucaccaacugcaacuacaacuucacgaagcuccugagcuuguucuccgucaacgacuucacgugcagccagaucagccccgccgcgaucgcguccaacugcuacagcucccucauccuggacuacuucagcuacccccuguccaugaaguccgaccucagcgugagcuccgccgggcccaucagccaguucaacuacaagcaguccuucagcaacccgaccugccugauccuggccaccgugccccacaaccucaccacaaucaccaagccgcugaaguacuccuacaucaacaagugcucgcggcugcuguccgacgaccgcaccgaggucccccagcuggugaacgccaaccaguacagccccugcguguccaucguccccagcacggugugggaagacggggacuacuaccggaagcagcugucgccgcucgagggcggcggguggcugguggcauccggccccaccgucgcgaugaccgagcagcugcagaugggguucggcaucaccgugcaguaugggacugacacgaacagcgugugccccaagcucgaguucgccaacgacaccaaaaucgccucccagcugggcaacugcgucgaguacagccuguacggcguguccgggaggggcguguuccagaacugcaccgccgucggcgugcggcagcagcgcuucguguacgacgcguaccagaaccucgucggcuacuacagcgacgacggcaacuacuacugcuugcgggccugcguguccgugcccgucagcgugaucuaugacaaggagaccaagacgcacgccacucuuuucgggucaguggccugcgagcacaucagcuccaccaugagccaguacucccgcagcacccgcuccaugcugaagcggcgcgacagcacguacggcccccuccagacacccgucgggugcgugcuaggacuggugaacuccagccucuucguagaggacugcaagcugccccugggacagucccucugcgcccugccggacacccccagcacccugacgcccuga

SEQ ID NO: 2290 - RNA, 2244 nt, Artificial Sequence; identical to SEQ ID NO: 1650
  derived and/or modified CDS sequence (opt11) from MERS-CoV__ALB08257__S1

SEQ ID NO: 2291 - RNA, 2244 nt, Artificial Sequence; identical to SEQ ID NO: 1685
  derived and/or modified CDS sequence (opt11) from MERS-CoV__ALB08311__S1

SEQ ID NO: 2292 - RNA, 2244 nt, Artificial Sequence
  derived and/or modified CDS sequence (opt11) from MERS-CoV__ALB08322__S1
augauccacagcguguuccugcucauguuccugcugacccccaccgaguccuacgucgacgugggcccugacagcgugaaguccgccugcaucgaggucgacauccagcagacguucuucgacaagaccuggccccgccccaucgacgugagcaaggccgacgggaucaucuauccccagggccggaccuacaguaacaucaccaucacguaccagggccucuucccguaccagggcgaccacggggacauguacguguacagcgcgggcuacgccaccggcaccacgccccagaagcuguucgucgccaacuacucccaggacgugaagcaguucgccaacggguucgugguccgcaucggcgccgcggccaacuccaccgggaccgugaucauaucccccagcaccuccgccaccauccggaagaucuaccccgccuucaugcugggcuccuccguggggaacuucagcgacggcaagaugggccgcuucuucaaccacacgcucguccugcugccggacgggugcggcacccuccugcgggcguucuacugcauccuggagccccgcagugggaaccacugccccgccggcaacagcuacaccaguuucgccaccuaccacacgccugccaccgacugcagcgacggcaacuacaaccggaacgccucccucaacagcuucaaggaguacuucaaccugcgcaacugcaccuucauguacaccuacaauaucaccgaggacgagauccuggagugguucgggaucacccagaccgcgcagggcgugcaccucuucagcucccgguacguggaccuguacggcggcaacauguuccaguucgccacccuuccggucuacgacacuaucaaguacuacagcaucaucccccacuccauccgcagcauccagucugaccggaaggccugggccgccuucuacguguacaagcuccagccccugaccuuccugcucgauuucagcguggacggguacauccgccgggcgaucgacugcggcuucaacgaccuaucccagcugcacugcagcuacgaguccuucgacgucgagagcggcguauacucggucagcuccuucgaggccaagcccagcggguccgucguggagcaggccgaggguguggagugcgacuucaguccgcuauuauccgggaccccgccccaggucuacaauuucaagcgccugguguucaccaauugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccgggcccaucagccaguucaacuacaagcaguccuucagcaacccgaccugccugauccucgccaccgugccccacaaccugacuaccaucaccaagccccugaaguacuccuacaucaacaaguguucucggcuccuguccgacgggcgcaccgaggugccccagcuggugaacgccaaccaguacagccccugcguguccaucguccccagcacggugugggaggacggcgauuacuaucggaagcagcucagcccgcuggagggcgggggcuggcucguggccuccggaagcaccgucgcaaugaccgagcaguugcagaugggcuucgggaucaccgugcaguacggcacugacacgaacuccgugugccccaagcuggaguucgccaacgacaccaagaucgccagccagcugggcaacugcgucgaguacucccuauacggggugagcggccgcgggguguuccaaaacugcaccgccgucggcgugcggcagcagcgcuucguguacgacgcguaccagaaccuggucggcuacuacuccgacgacgggaacuacuacugccugcgggccugcgugagugugcccgucuccgugaucuacgacaaggagaccaagacgcacgccacccuguucggcagcguggccugcgagcacaucuccagcaccaugucccaguacagccgcuccacccgcagcaugcucaagcggcgugacuccacguacgggccgcugcagacccccgucggcugcgugcuggggcucgugaacagcucccuguucgucgaggacugcaagcugccccucggccagagccugugugcccugcccgacaccccgagcacccucacgcccuga

SEQ ID NO: 2293 - RNA, 2244 nt, Artificial Sequence; identical to SEQ ID NO: 1650
  derived and/or modified CDS sequence (opt11) from MERS-CoV__ALD51904__S1

SEQ ID NO: 2294 - RNA, 2244 nt, Artificial Sequence
  derived and/or modified CDS sequence (opt11) from MERS-CoV__ALJ54446__S1
augauccacagcguguuccugcucauguuucugcugacccccaccgaguccuacgucgacgugggcccggacagcgugaaguccgccugcaucgagguugacauccagcagacguucuucgacaagaccuggccccgccccaucgaugugucgaaggccgacggcaucaucuauccgcagggccggaccuacuccaacaucaccaucacguaccagggccucuucccguaucagggcgaccacggggacauguacguguacagcgcgggccacgcaaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccgugggcaacuucucggacggcaagaugggccgcuucuucaaccacacgcucgucuuacugccggacgggugcggcacccuccugcgggcuuucuacugcauccuggaaccccgcuccgggaaccacugccccgccggcaacuucuacaccucguucgccaccuaccacacgcccgccaccgacugcuccgacggcaacuacaaccggaacgcgagccucaacuccuucaaagaguacuucaaccugcgcaacugcaccuucauguacaccuacaacaucacggaggacgagauccuggagugguucgggaucacccagaccgcgcagggcgugcaccucuucagcagcagguacguggaccuguacggggguaacauguuccaguucgccacccugccggucuaugacacgaucaaguacuacuccaucauaccccacagcauccgcuccauacagagcgaccgaaaggccugggccgccuucuacguguacaagcuccagccccucaccuuccugcucgacuuuuccguggacggguacauucgccgggcgaucgacugcggcuucaacgaccugagccagcugcacugcuccuacgagagcuucgacgucgaguccggcguguacagcgugucgagcuucgaggccaagcccuccgggagcgucguggagcaggcagagggcguggagugcgacuucuccccgcuccugagcgggaccccgccccaggucuacaacuucaagcgccugguguucaccaacugcaacuacaaccucacgaagcugcugucccucuucagcgucaacgacuucaucugcucccagaucagccccgccgccaucgcgagcaacugcuacuccagucugauccuggacuacuucuccuacccccucagcaugaaguccgaccugagcguguccagcgccgggcccaucucccaguucaacuacaagcagagcuucuccaacccgaccugccugauccucgccaccgugccccacaaccugacuacgaucaccaagccccugaaguacagcuacaucaacaagugcucccggcuccugagcgacgaccgcaccgaggucccccagcuggugaacgccaaccaguacucccccugcgugagcaucguccccuccaccgugugggaggacggggacuacuaccggaagcagcucagcccgcuggagggcggcggguggcugguggccagcggcaguacggucgcuaugaccgagcagcuccagaugggcuucggaaucaccgugcaguacgggaccgauaccaacagcgucugccccaaguuagaguucgccaacgacacgaaaaucgccucccagcugggcaacugcgucgaguacagccucuacggcguguccgggcgcggcguguuccagaacugcaccgccgucggggugcggcaacagcgcuucguguacgacgcguaccagaaucuggucggcuacuacagcgacgacggcaacuacuacugccugcgggccugcguguccgugcccgucagcgugaucuacgacaaggagaccaagacccacgccacgcuguucggguccguggccugcgagcacaucagcuccaccaugagccaguacucccgcaguacccguuccaugcucaagcggcgcgacagcaccuacggcccacugcagacgcccgucgggugcgugcugggccucgugaacuccagccuguucgucgaggacugcaagcugccccucgggcagucccugugcgcccuucccgacaccccgagcacccucacgcccuga

SEQ ID NO: 2295 - RNA, 2244 nt, Artificial Sequence; identical to SEQ ID NO: 1689
  derived and/or modified CDS sequence (opt11) from MERS-CoV__ALJ54448__S1

SEQ ID NO: 2296 - RNA, 2244 nt, Artificial Sequence; identical to SEQ ID NO: 1690
  derived and/or modified CDS sequence (opt11) from MERS-CoV__ALJ54450__S1

SEQ ID NO: 2297 - RNA, 2244 nt, Artificial Sequence
  derived and/or modified CDS sequence (opt11) from MERS-CoV__ALJ54453__S1
augauccacagcguguuccugcucauguuccugcugacccccacugaguccuacgucgacguggguccggacagcgugaaguccgccugcaucgaggucgacauccagcagacguucuucgacaagaccuggccccgccccaucgacgugagcaaggccgacgggaucaucuacccccagggccggaccuacucuaacaucaccaucacguaucaaggccucuucccguaccagggcgaccacggggacauguacguguacagcgcgggccacgccaccggcaccacgccccagaagcuguucguugccaacuacucccaggacgugaagcaguucgccaacggguucgugguuagaaucggcgccgcggccaacagcaccgggaccgugaucaucucccccagcaccucggccaccauccggaagaucuaccccgccuucaugcugggcucguccguggggaacuucagcgacggcaagaugggccgcuucuucaaccacacgcucguccugcugccggacgggugcggcacccuccugcgggcguucuacugcauccuggagccccgcuccgggaacuacugccccgcgggcaacucguacaccaguuucgccaccuaccacacgcccgccaccgacugcagcgacggcaacuacaaccggaacgccucccucaacagcuucaaggaguauuucaaccugcgcaacugcaccuucauguacacuuacaacaucaccgaggacgaaaucuuggagugguuugggaucacccagaccgcgcagggcgugcaccucuuuagcucccgguacguggaccuguacgggggcaacauguuccaguucgccacccugccggucuacgacacgaucaaguacuacucaaucaucccccacaguauccgcagcauucaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaagccgagggcguggagugcgacuucagcccgcuccuguccgggaccccgccccaggucuacaacuucaagcgccugguguucaccaacugcaacuacaaucucacgaagcugcugagccucuucuccgucaacgacuucacgugcagccagaucagccccgccgccaucgcguccaacugcuacagcucccugauccuggacuacuucagcuaccccuuauccaugaaguccgacuugagcgugagcuccgccgggcccaucagccaguucaacuacaagcaguccuucagcaacccgaccugccugauccucgccaccgugccccacaaccugaccaccauuaccaagccccugaaauacuccuacaucaacaagugcagccgguugcuguccgacgaccgcaccgaagucccccagcuggugaacgccaaccaguacucucccugcguguccaucguccccagcacggugugggaggacggggacuacuaccggaagcagcucagcccgcuggagggcggcggguggcugguggccuccggcagcaccgucgcgaugaccgagcagcuccagaugggcuucggcaucaccgugcaguacgggaccgacacgaacagcgugugccccaagcuggaguucgccaacgacaccaagaucgccucacagcugggcaacugcgucgaguacucccucuacggcgugagcgggcgcggcguguuccagaacugcaccgccgucggagugcggcagcagcgcuucguguacgacgcguaccagaaccuggucggcuauuacuccgacgacggcaacuacuacugccugcgggccugcgugagcgugcccgucuccgugaucuacgacaaggagaccaagacgcacgccacccuguucgggagcguagccugcgagcacaucuccagcaccaugucccaguacagccgcuccacccgcagcaugcucaaacggcgcgacuccacguacggcccgcugcagacccccgucgggugcgugcugggcuuagugaacagcucccuguucgucgaggacugcaagcugccccucgggcagagccucugcgcccugcccgacaccccgaguacccucacgcccuga

SEQ ID NO: 2298 - RNA, 2244 nt, Artificial Sequence
  derived and/or modified CDS sequence (opt11) from MERS-CoV__ALJ54455__S1
augauccauagcguguuucugcucauguuccugcugacccccaccgaguccuacgucgacgugggcccggacagcgugaaauccgccugcaucgccgucgacauacagcagacuuucuucgacaagaccuggccccgccccaucgacguaagcaaagccgaugggaucaucuacccccagggccgaaccuacucgaacaucacaaucacguaccagggccucuuccccuaccagggcgaccacggggacauguauguguacagcgccggccacgccaccggcaccacgccccagaagcuguucgucgccaacuacucccaagacguuaaacaguucgccaacgguuucgugguccgcauaggcgcggccgccaacagcaccgguaccgugaucaucuccccgagcacguccgccaccauccggaagaucuaccccgcguucaugcugggaagcuccguggggaauuuuagcgacggcaagaugggccgguucuucaaccacacacucguccugcucccggacgguugcggcacccuccugcgggccuucuacugcauccuggagccccgcuccgggaaccacugccccgccgguaacagcuacaccuccuucgcuaccuaccauacgcccgcaacugacugcagcgacggcaacuacaaccggaacgcgucccucaacucauucaaggaguacuucaaccugaggaacugcaccuucauguauaccuacaacauuacggaggacgagauccuggagugguuugggaucacgcagaccgcccagggcgugcaccucuucagcucccgguacguggaccuguacggaggcaacauguuccaguucgccacccuaccggucuacgacacgaucaaguacuacucuaucauuccccacuccauccgcagcauccaguccgaccggaaggccugggccgcguucuacguguacaagcuccagccccugaccuuccugcucgacuuuagcguggacggguacauccgccgggcaauagacugcggcuucaacgaccucucccagcugcauugcagcuacgaguccuucgacgucgagucaggcguguacuccgugagcucuuucgaagccaagcccagcggguccgucguagagcaggccgaaggcguggagugcgacuucagcccgcuucucuccgggacaccgccccaggucuacaacuuuaagcgccugguguucaccaacugcaacuacaaccucacgaaacugcugagccucuucuccgucaacgacuucacgugcagccagauaagccccgccgccaucgccuccaacugcuacagcucccugauccuggacuacuucagcuaccccuuauccaugaaguccgaccugagcgugagcucugccgggccuaucucacaguucaauuacaagcaguccuucagcaacccgaccugccugauccucgccaccgugccccacaaccugaccaccauuaccaagccccugaaguacuccuacaucaacaagugcucgcggcuccuguccgacgaccgcaccgagguuccccagcuggugaacgccaaucaguacagccccugcguguccaucguccccagcacggugugggaggacggggacuacuaucggaagcagcucagcccacuggagggaggcggguggcugguggcgagcggcagcaccgucgccaugaccgagcagcuccaaaugggguucgguaucaccgugcaguacgggaccgacacgaacuccgugugcccgaagcuggaguucgccaaugacaccaagaucgccucccagcugggaaacugcguugaguacucccucuacggcgugagcgggcgcggcguguuccagaacugcaccgcggucggggugcggcagcagagguucguguacgacgccuaccagaaccuagucggcuacuacuccgacgacgguaacuacuacugccugcgggccugcgugagcgugcccguauccgugaucuacgacaaggagaccaagacgcacgccacccuguucgggagcguggccugcgagcacauuucaagcaccaugucccaauacagccgcuccacccgcagcaagcucaagcggcgcgacuccacguacggcccgcugcagaccccugucgggugcguucugggccucgugaacagcucgcuguucgucgaggacugcaagcugccacucggacagagccugugcgcgcugccugacacgccgagcacgcucaagcccuga

SEQ ID NO: 2299 - RNA, 2244 nt, Artificial Sequence
  derived and/or modified CDS sequence (opt11) from MERS-CoV__ALJ54456__S1
augauccacagcguguuccugcucauguuccugcuuaccccuaccgaguccuacgucgacgugggaccggacagcgugaaguccgcguguaucgccgucgacauccagcagacguucuucgacaagaccuggccccgccccaucgacgugagcaaggcggacgggauaaucuacccccagggccggaccuacuccaacaucacgaucacguaccagggccucuucccauaccagggugaccacggggauauguacgucuacagcgccggccaugccaccggcacaacgccucagaagcuguucgucgccaacuacucccaggacgugaagcaguucgccaacggguucgugguccgcaucggcgcggccgccaacagcaccgggaccgugauuaucucccccagcaccuccgccaccauccggaagaucuaccccgccuucaugcucgguagcuccguggggaacuucagcgacggcaagaugggccgcuucuucaaucacacgcucguccugcugccggacgggugcggcacccuccuucgagccuucuauugcauccuggagccccgcagugguaaccacugccccgccggcaacagcuacacauccuuugccaccuaccacacgcccgccacugacugcagcgauggcaacuauaaccggaacgcgucccuaaacagcuucaaggaguauuucaacuuaaggaacugcaccuucauguacaccuacaauaucacggaggaugaaauccuggagugguuugggaucacccagaccgcccaaggcguccaccucuucuccucccgguacguggaccuguacgggggcaacauguuccaguucgccacccugccggucuacgacacgaucaaguacuacagcaucaucccccacuccauccgcuccauccaguccgaccggaaggccugggccgcuuucuacguguacaagcuccagccccugacauuccugcucgacuuuagcguggacggguacauccgucgggccauugauugcggauucaacgaccugucccagcugcacugcucauacgaguccuucgacgucgagagcggcguguacuccguuagcuccuucgaggccaagcccagcggguccgucguggaacaagccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucucccccgccgcgaucgccuccaacugcuacagcucccugauccuugacuacuucagcuacccccucuccaugaaguccgaccugagcguguccuccgccgggcccaucucccaauucaacuacaagcaguccuucagcaauccuaccugccugauccucgccaccgucccccacaaccugaccaccaucaccaagccccugaaguacuccuacaucaacaagugcagccggcuccuguccgaugaccgcaccgaagucccgcagcucgugaacgccaaucaguauagccccugcguguccaucguccccagcacagugugggaggacggggacuacuaccggaagcagcucagcccccuggaggguggcggauggcugguggcguccggcagcacggucgccaugaccgagcagcuccagaugggguucggcaucacugugcaguaugggaccgacacgaacuccgugugccccaagcuggaguucgccaacgacaccaagaucgccagccagcugggcaauugcgucgaauacucccucuacggggucuccggucgcggcguguuccagaacugcaccgcggucggggugcgacagcagcgguucguguacgacgccuaccagaaccuggucggcuacuacuccgacgacggcaacuacuacugccugcgggccugcgugagcgugcccgucuccgugaucuacgauaaggagaccaagacgcacgccacacuauucgggagcguggcaugugagcacaucuccagcacaaugagccaguacagccgcuccacccgaagcaugcucaagcggcgcgacuccacguacggcccgcugcagaccccagucgggugcgugcugggccucgugaacagcucccuguucgucgaggacugcaaguuacccuuggggcagagccugugugcucugccagacaccccgagcacccucaagcccuga

SEQ ID NO: 2300 - RNA, 2244 nt, Artificial Sequence; identical to SEQ ID NO: 1694
  derived and/or modified CDS sequence (opt11) from MERS-CoV__ALJ54461__S1

SEQ ID NO: 2301 - RNA, 2244 nt, Artificial Sequence
  derived and/or modified CDS sequence (opt11) from MERS-CoV__ALJ54468__S1
augauccacagcguuuuccugcucauguuuuuacugacccccaccgaguccuacgucgacgugggcccggacagcgugaaguccgccugcaucgaggucgacauccagcagacguucuuugacaagaccuggccccgccccaucgacgugagcaaggccgaugggaucaucuauccccaggggcggaccuacucgaacaucaccaucacguaucagggccucuucccguaccagggcgaucacggggacauguacguguacagcgcgggccaugccaccggcacgacgccccagaagcuguucgucgccaacuacucccaggacguaaagcaguucgccaacggguucgugguccgcaucggcgcggcggcuaacucuaccgggacugugaucaucucccccagcacguccgccaccauccggaagauauaccccgcuuucaugcugggcagcuccgucgggaacuucagcgacggcaagaugggccgcuuuuucaaccacacgcucguccugcuuccggacgggugcggcacccuccugcgggcguucuacugcaucuuggagccucgcuccgggaaccacugccccgccggcaacagcuacaccuccuucgccaccuaccacacgcccgccaccgacugcagcgacggcaauuacaaccggaacgccucccucaacaguuucaaggaguacuucaacuuacgcaacugcaccuucauguacaccuacaacaucacggaggacgagauccuggagugguuuggcaucacccagaccgcgcagggcguccaccucuucagcucccgguacgucgaccuuuacggugggaacauguuccaauucgcaacccugcccgucuacgacacaaucaaauacuauagcaucauaccccacuccauccggagcauccaguccgaccggaaggccugggccgccuucuacguguacaagcuccagcccuuaaccuuccugcucgacuucagcguggacggguacauccgucgggccaucgacugcggcuucaacgaucugucacagcuacacuguagcuacgaguccuuugacgucgagagcggcguguacuccgugagcuccuucgaggccaagcccagcggguccgucguggagcaggcagaggguguagagugcgacuucagcccguuacuguccgggaccccgccccaagucuacaacuucaagcgccugguguucaccaauugcaacuacaaccuaacgaagcugcugagucucuucuccgucaacgacuucaucugcagccaaaucagccccgccgccaucgcguccaacuguuacagcucccugauccuggacuacuucagcuacccccucuccaugaaguccgaccugagcgucagcuccgcuggacccaucagccaguuuaauuacaagcaguccuucagcaacccgaccugccucauccucgccaccgugccccacaaucugaccacaaucaccaagccccugaaguacuccuacauuaacaagugcagccggcuccuguccgacgaccguaccgaggucccccagcuggugaacgccaaccaguacagccccugcguguccaucguccccagcaccgugugggaggacggggacuacuaucggaagcagcucucgccccuggaaggcggcggguggcugguggccuccggcagcacggucgcgaugaccgaacagcuccagauggguuucggcaucaccgugcaguacgggaccgacaccaacucagugugccccaagcuggaguucgccaacgauacgaagaucgccagccagcugggcaacugcgucgaguacucacuguacggcgugagcgggcgcggcguuuuccagaacugcaccgccguuggggugcggcagcagagauucguguacgacgcguaccagaaccucgucggcuacuacuccgacgacggcaacuauuacugccugcgggccugcguuagcgugcccgucuccgugaucuacgacaaagagaccaagacacacgccacgcuguucgggagcguggccugcgagcacaucuccagcaccaugucccaguacagccgcuccacccgcagcaugcucaagcggcgcgacuccaccuacggcccucugcagacacccgucgggugcgugcugggccucgucaacagcucccuguucgucgaggacugcaagcugccccuagggcagagccugugcgcgcugcccgacaccccaagcacccucacgcccuga

SEQ ID NO: 2302 - RNA, 2244 nt, Artificial Sequence
  derived and/or modified CDS sequence (opt11) from MERS-CoV__ALJ54471__S1
augauccacagcguguaccuccucauguuucugcugacccccacugaauccuacgucgacgugggcccggacagugugaaguccgccugcaucgaggucgauauccagcagacguucuucgacaagaccuggccccgccccaucgacgucagcaaggcggacgggauuaucuacccccaaggccggaccuauuccaacaucaccaucacguaccagggccucuucccguaccagggcgaccacggggacauguacguguauucugcggggcacgccaccggcaccacgccccagaagcuguucgucgccaacuacucccaggacgugaagcaguucgccaacggguucgugguccgcaucggcgccgcggccaauucgaccggaaccgugaucaucucgcccucaacauccgccaccauccggaagaucuaccccgccuuuaugcugggcagcuccguggggaacuucagcgacggcaagaugggccgcuucuucaaccacacgcucguccugcugccggacgggugcggcacccuccugcgggccuucuacugcauccuggagccccgcuccgggaaccacugccccgccggcaacagcuacaccuccuucgccaccuaccacacgcccgccaccgacugcagcgacggcaacuacaaccggaacgccucccucaacucuuucaaggaguacuucaaccugcgcaacugcaccuucauguacaccuacaacaucacagaggacgagauccuggagugguucgggaucacccagaccgcgcagggcgugcaccucuucagcucccgguacgucgaccuguacggcgggaacauguuccaguucgccacccugccggucuacgacacgaucaaguacuacagcaucaucccccacuccauccgcagcauccaguccgaccggaaggccugggccgccuucuacguuuacaagcuccagccccugaccuuccugcucgacuucagcguggacggguacauccgccgggcgaucgacugcggguucaacgaccugucccagcugcacugcagcuacgaguccuucgacgucgaguccggcguguauuccgugagcuccuuugaggccaaacccagcggguccgucguggagcaggccgagggcguggagugcgacuucagcccgcuccuguccgggaccccgccccaggucuacaacuuuaagcgccuaguguucacaaacugcaacuacaaccuuaccaagcugcuaucacucuucuccgucaacgacuucacgugcagccaaauuagcccagccgccauugcguccaacugcuacagcucccugauccuggacuacuucagcuaccccuuauccaugaaguccgaccugagcgugagcuccgccgggcccaucagccaguucaacuacaagcaguccuucagcaacccgacaugucugauccucgccaccgugccccacaacuuaaccaccauaaccaagccgcugaaguauuccuacaucaacaagugcagccggcuccugagugacgaucgcaccgaggucccccagcuggugaacgcuaaccaguacagccccugcguguccaucguccccagcacggugugggaggacggggacuacuaccggaagcagcucagcccgcuggagggcggcggguggcugguugccuccggcagcaccgucgcgaugacugagcagcuccagaugggguucggcaucaccgugcaguacgggaccgacacaaacuccgugugccccaagcuggaguuugccaacgacaccaagaucgccagccagcuggguaacugcgucgaguacucccuguauggagugagcgggcgcggcguguuccagaacugcaccgccgucggggugcggcagcagcgcuucguguacgacgcguaccagaaccuggucggcuacuacuccgacgacggcaacuacuauugccugcgggccugcgugagcgugcccguauccgugaucuacgauaaagagaccaagacgcacgccacccuguucgggagcguggccugugagcacaucuccagcaccaugucccaguauagccgcuccacccggagcaugcucaagcggcgcgacuccacguacggcccgcugcaaaccccugucgggugcgugcugggcuuggugaacagcucccuguucgucgaggacugcaagcugccccucggccagagccugugcgcccugcccgauaccccaagcacccucacucccuga

SEQ ID NO: 2303 - RNA, 2244 nt, Artificial Sequence; identical to SEQ ID NO: 1697
  derived and/or modified CDS sequence (opt11) from MERS-CoV__ALJ54472__S1

SEQ ID NO: 2304 - RNA, 2244 nt, Artificial Sequence
  derived and/or modified CDS sequence (opt11) from MERS-CoV__ALJ54474__S1
augauccacagcguguuccuguuaauguuccugcugaccccaaccgaguccuacgucgacguuggcccagacagcgugaaguccgccugcaucgaagucgacauccagcaaaccuucuucgacaaaacauggccccgcccuauagacgugagcaaggccgacgggaucaucuacccccagggccggaccuacuccaacauaaccauaacguaucagggccuauuucccuaccagggggaccacggggacauguacguguacuccgcgggccacgccacgggcacaacuccccagaaauuauucguugccaacuacucccaggacgugaagcaguucgccaacggguuugugguccgcaucggcgcugcggccaauagcacugggaccgugauaauuuccccaagcaccuccgcgaccauccggaagauauaccccgccuucaugcuaggcucauccgugggcaacuucagcgacgguaagaugggccgcuucuucaaccacacgcuuguacugcugccugacgggugcggcacccuccugcgggcguucuacugcauccuggaaccccgcuccgggaaccacugccccgccggaaacagcuacaccucguucgcuaccuaccacacgcccagcaccgacuguuccgacggcaacuacaaccggaacgccagccuaaauagcuucaaggaauacuucaaccugcgcaauugcaccuucauguacaccuacaacaucacggaggacgaaauccuggagugguucgggaucacacagacggcccagggcgugcaccucuucuccagccgguacguggaccuguacggcggcaacauguuccaauucgcgacccugccggucuacgacacgaucaaguauuacuccaucaucccccauagcauccgcuccauccagagcgacagaaaggccugggccgcguucuacguguauaagcuccaaccccugacuuuccuucucgauuucuccguggauggguacauccgccgagccaucgacugcggcuucaacgaucuuagccaauuacacugcuccuacgagucguucgacguugaguccggcguguacagcguguccagcuucgaggcgaagcccuccgggagcgucgucgagcaggccgaaggcguggagugcgacuucuccccgcuccugagcgggaccccgccccaggucuacaauuucaagcgccugguuuucaccaacuguaacuacaaccucacaaagcugcucucccucuucagcgucaaugacuuuacgugcucacagaucucccccgccgccaucgccucuaacugcuacuccagccugauccuggacuacuucuccuacccccucaguaugaagagugaucugagcguauccagcgcggggcccaucucccaguucaacuacaagcagagcuucagcaacccgaccuguuuaauccucgcaaccguuccccacaaccugaccaccaucaccaagccccuuaaguacaguuacaucaacaaguguucccggcuccugagcgacgaccgcaccgaggucccccaacuggugaacgccaaccaauacuccccuugcgucagcaucguccccucgacggugugggaggacggggacuacuaccggaagcagcucuccccgcucgagggcggcgggugguuaguagccagcggcuccaccgucgccaugaccgagcagcuccagaugggguucggcaucaccgugcaguacgggaccgacacgaacagcgucugccccaagcuggaguucgcgaaugacaccaagaucgcaagccagcugggcaacugcgucgaauacagccuguacggcguauccgggcgcggcguguuccagaacuguaccgccguuggggugcggcagcagcgcuucguguacgacgccuaccaaaaccuggucggcuacuacagcgacgacggcaacuauuacugccugcgggcgugcguguccgugcccgucagcgugaucuacgauaaggagaccaagacccacgccacccuguucggguccguggccugcgagcacaucagcuccaccaugagccaguacucccgcagcacccgcuccaugcucaagcggagggacagcacguauggcccgcugcagacccccgucgggugcgugcugggccucgugaacuccagccuauucgucgaggacugcaaguuaccccucgggcaaucgcugugcgcccuccccgacaccccguccacccuuacgcccuga

SEQ ID NO: 2305 - RNA, 2244 nt, Artificial Sequence; identical to SEQ ID NO: 1699
  derived and/or modified CDS sequence (opt11) from MERS-CoV__ALJ54483__S1

SEQ ID NO: 2306 - RNA, 2244 nt, Artificial Sequence; identical to SEQ ID NO: 1700
  derived and/or modified CDS sequence (opt11) from MERS-CoV__ALJ54486__S1

SEQ ID NO: 2307 - RNA, 2244 nt, Artificial Sequence; identical to SEQ ID NO: 1701
  derived and/or modified CDS sequence (opt11) from MERS-CoV__ALJ54488__S1

SEQ ID NO: 2308 - RNA, 2244 nt, Artificial Sequence; identical to SEQ ID NO: 1702
  derived and/or modified CDS sequence (opt11) from MERS-CoV__ALJ54490__S1

SEQ ID NO: 2309 - RNA, 2244 nt, Artificial Sequence
  derived and/or modified CDS sequence (opt11) from MERS-CoV__ALJ54495__S1
augauccacagcguguuccuucugauguuucuauuaacccccaccgaguccuacguagacguugguccggauagcgugaaguccgccugcauugaggucgacauccagcagacuuucuuugacaagaccuggccccgccccaucgacgugagcaaggccgacgggaucaucuauccccagggccggaccuacuccaacauuaccauuacguaucaaggccucuuuccguaccagggcgaccacggggacauguacguguacagcgcgggccacgccaccggcaccacgccccagaagcuguucgucgccaacuauucucaggacguaaaacaguucgccaauggauucgugguccgcaucggcgccgcggccaacagcaccgggaccgugaucaucuccccgagcaccuccgccaccauccggaaaauauaccccgccuucaugcugggcucguccguggggaacuucagcgacggcaagaugggccgcuucuucaaucacacgcucguccuguuaccggacggguguggaacccugcugcgggcuuucuacugcauccucgagccucgguccgggaaccacugccccgcuggcaacagcuacaccuccuucgcaacguaucacacucccgccaccgacugcagcgacggcaacuacaaucggaacgccucgcucaauagcuucaaggaguacuucaaccuccgcaacugcaccuucauguacaccuacaacaucacggaggacgaaauccuggagugguucgggaucacgcaaaccgcgcagggcgugcaucuguucagcucccgguacguagaccuguacgggggaaacauguuccaguucgccacacugccggucuacgacacgaucaaguacuacagcaucaucccgcacucaauacgcagcauccaauccgaccggaaggccugggccgccuucuacguguauaagcuccagccucugaccuuccugcucgacuucuccguggacggguacauccgccgggcgaucgacugcggcuucaacgaccugucccagcugcauuguagcuacgaguccuucgacgucgagagcggcguguacucuguaagcuccuucgaggccaagccuagcggguccgucguagagcaggccgagggcguagagugcgacuucucaccgcuucuguccgggaccccgccccagguuuauaacuucaagaggcugguauucaccaacugcaacuacaacuuaaccaaacugcugagccucuucuccgucaacgacuucacgugcucucagauuagccccgccgccaucgcauccaacugcuacucaucccugauccuggauuacuucagcuacccgcucucgaugaaguccgaccugagcgugagcuccgccgggccgaucagccaguucaacuauaagcaguccuucagcaacccgaccugccugauccucgccaccgugccccacaaccugaccaccaucaccaagccccugaaguauucguacaucaacaagugcagcaggcuccuguccgacgaccgcacggagguaccccagcugguaaacgccaaccaguacucacccugcguguccaucguccccagcacggugugggaggacggggacuacuaucggaagcagcucagcccguuggagggcggcggguggcuggucgucuccggcagcacgguggccaugaccgagcaacuccagaugggguuuggcaucaccgugcaguacgggaccgacacuaacuccgucugccccaaacuggaguuugcaaacgacaccaagaucgccagccaacugggcaacugcguggaguacucacucuacggcgugagcgggcgcggcgucuuccagaacugcacagccguaggcgugcggcagcagcgcuucguauacgacgccuaccagaaccuggugggcuacuacuccgacgauggcaacuacuauugccugcgggcgugcgugagcgucccgguguccgugaucuacgacaaggagaccaaaacgcacgcuacccuguucggaagcguugccugcgaacacaucucgagcaccaugucccaauacagccgcuccacccgcagcaugcucaagcggagagacuccaccuauggcccauugcagacgcccguagggugcgugcugggacucgucaacagcucucuguucguggaggacuguaaguugccccucgggcagagccugugugcccugcccgauaccccaagcacccucacgcccuga

SEQ ID NO: 2310 - RNA, 2244 nt, Artificial Sequence; identical to SEQ ID NO: 1704
  derived and/or modified CDS sequence (opt11) from MERS-CoV__ALJ54496__S1

SEQ ID NO: 2311 - RNA, 2244 nt, Artificial Sequence
  derived and/or modified CDS sequence (opt11) from MERS-CoV__ALJ54500__S1
augauccacagcguguuccugcucauguuccugcugacacccaccgaguccuacgucgacgugggcccagacagcgugaaguccgccugcaucgaggucgacauccagcagacguucuucgacaagaccuggccccgccccaucgacgugagcaaggccgacgggaucaucuacccccagggccguaccuacuccaacauaaccaucacguaccagggccucuucccguaccagggggaccacggggacauguacguguacagcgcgggccacgccaccggcaccacgccucagaagcuguucgucgccaacuauucccaggacgugaagcaguucgccaacggguucgugguccgcaucggcgccgcggccaacagcaccgggaccgugaucaucucccccagcaccuccgccacuauccggaagaucuaccccgccuucaugcugggcagcuccguggggaacuucagcgacggcaagaugggccgcuucuucaaccacacgcucguccugcugccggacgggugcggcaccuugcugcgggcguucuacugcauccuggagccccgcuccgggaaccacugccccgccggcaacagcuacaccuccuucgccaccuaccacacgcccgccaccgacugcagcgauggcaauuacaaccggaacgccucccucaacagcuucaaggaguacuucaaccugcgcaacugcaccuucauguacaccuacaacaucacggaggacgagauccuggagugguucgggaucacgcagaccgcgcagggcgugcaccuguucagcucccgguacguggaccuguacgggggcaacauguuccaguucgccacccugccggucuacgacacuaucaaauacuacagcaucaucccccacuccauccgcagcauccaguccgaccggaaggccugggccgccuucuacguguacaagcuccagccccugaccuuccugcucgacuucagcguggacggguacauccgucgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagccuccugcuguccgggaccccgccgcaggucuacaacuucaagcgccucguguucaccaacugcaacuacaaccugacgaagcuccucagccuguucuccgucaacgacuucacgugcagucagaucagccccgccgccaucgccuccaacugcuacagcucccugauccucgacuacuucagcuacccccuguccaugaaguccgaccugucugugagcuccgccggcccgaucagccaguucaacuacaaacaguccuucagcaacccgaccugccucauccuggccaccgugccccacaaccugaccaccaucaccaaaccccucaaguacuccuacaucaacaagugcagccggcugcuguccgacgaccgcaccgaggucccccagcucgugaacgccaaccaauacagccccugcguguccaucguccccagcacgguuugggaggacggggauuacuaccggaagcagcucucacccuuagagggcggcggguggcucguagccuccggcagcaccgucgcgaugaccgagcagcugcaaaugggguucggcaucaccgugcaguacgggaccgacacgaacuccgugugcccgaagcuggaguucgccaacgacaccaagaucgccagccagcucggcaacugcgucgaguacuccuuguacggcgugagcgggcgcggcguguuccagaacuguaccgccgucggggugcggcagcagcgcuucguguacgacgcguaccagaaccuggucggcuacuacuccgacgacggcaacuacuacugucugcgggccugcgugagcgugcccgucuccgugaucuacgacaaggagaccaaaacgcacgccacccucuucgggagcguggccugcgagcacaucuccagcaccaugucccaauacagccgcuccacccgcagcaugcugaagcggcgcgacuccacguacggcccccugcagacccccgucgggugcgugcucggccugguuaacaguucccuguucgucgaggacugcaagcucccccuggggcagagccugugcgcccuccccgacacccccagcacucugacgccguga

SEQ ID NO: 2312 - RNA, 2244 nt, Artificial Sequence
  derived and/or modified CDS sequence (opt11) from MERS-CoV__ALJ54501__S1
augauccauagcguguuccugcucauguuccugcugacccccaccgagucauacgucgacgugggcccggacagcgugaaauccgccugcaucgaagucgacauccaacagaccuucuucgacaagaccuggccccgccccaucgacgugagcaaggcagacgggaucaucuacccccaaggccggacauacuccaacaucaccaucacguaccagggccucuucccguaucagggggaccacggggacauguacguguacucagcgggccacgcgaccggcaccacgccccaaaagcuguucgucgccaacuacucccaggacgugaagcaguucgccaacggcuucgugguccgcaucggcgccgccgcaaacagcaccgguaccgugaucaucucccccagcaccuccgccaccauccggaagaucuaccccgccuucaugcugggcagcuccguggggaacuucagcgauggcaaaaugggccgcuucuucaaccacacgcucguccugcugccggaugggugcggcacccuccugcgagcguucuacugcauccuggagccccgcuccgggaaccacugccccgcagggaacagcuacaccuccuucgccaccuaccacacgcccgcgaccgacugcagcgacggcaacuauaaccggaacgccagccucaacagcuucaaggaguacuucaaccugcgcaacugcaccuucauguacaccuacaacaucacggaagacgagauccuggagugguucgggaucacccagaccgcgcagggcgugcaccucuucagcucgcgguacguggaccuguacgguggcaacauguuccaauucgccacgcugccgguuuacgacacgaucaaguacuacagcauaaucccccacucgauccgcagcauccaguccgaccggaaggccugggccgccuucuacguguacaagcuccaaccccugaccuuccugcucgacuucagcguggacggguacauccgccgggcgaucgacugcggcuuuaacgaccucucccagcugcacugcagcuacgaauccuucgacgucgagagcggcguguacuccgugucuuccuucgaggccaagcccagcggguccgugguggagcaggccgagggcguggagugcgacuucagcccgcucuuguccgggaccccgccccaggucuacaacuucaagcgccugguuuucaccaacugcaacuauaaccucacgaagcugcugagccucuucuccgucaacgacuucacgugcagccagaucagccccgccgccaucgcguccaacugcuacagcucccugauccuggacuacuucuccuacccgcucuccaugaaguccgaccugagcguaagcuccgccggccccaucagccaguucaacuacaagcaguccuucagcaacccgaccugccugauccucgcgaccgugccccacaacuugacaaccaucaccaagccccugaaguacagcuacauaaacaagugcagccgucuccuguccgacgaccgcaccgaagucccccagcuggugaacgccaaccaguacagccccugcguguccaucguccccagcacgcucugggaggacggggacuacuaccggaagcagcuuagcccccuggagggcggaggguggcucguggccuccggcagcacuguggcuaugacagagcagcugcagaugggguucggcaucaccguccaguacgggaccgacacgaacuccgugugcccaaagcuggaguucgccaacgacaccaagauagccagccagcucggcaacugcguugaauacagccuguauggcgucagcggccgcggcguguuccagaauugcaccgccguggggguccggcagcaacgcuucguuuacgacgcguaccagaaccuggugggcuacuauuccgacgauggcaacuacuacugccugcgggccugcgucagcgugcccguguccgucaucuacgacaaggagaccaagacgcacgcuacccuuuucgggucuguggccugcgagcacaucucaagcaccaugagccaguacagccgcuccacccgcagcaugcucaagagacgcgacuccacguacggcccgcugcagacccccguggguugcguccucggucuggugaauagcucccuguuuguggaggacugcaagcucccccuggggcaaagccugugugcccuccccgacaccccgagcacgcugacgcccuga

SEQ ID NO: 2313 - RNA, 2244 nt, Artificial Sequence
  derived and/or modified CDS sequence (opt11) from MERS-CoV__ALJ54502__S1
augauccacagcguguuccugcucauguuccugcugacccccaccgaguccuacgucgacgugggaccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggcgaccacggggacauguacguuuacagcgcgggccacgccaccggcaccacgccccagaagcuguucgucgccaacuacucccaggacgugaagcaguucgccaauggguuugugguccgcauaggcgccgcggccaacagcaccgggaccgugaucaucuccccgagcaccuccgccaccauccggaagaucuaucccgccuucaugcugggcagcuccguggggaacuucagcgacggcaagaugggccgcuucuucaaccacacgcucguccugcugccggaugggugcggcacccuccugcgggcguucuacugcauccuggagccccgcucagggaaccacugccccgccggcaacagcuacaccuccuucgccacauaccacacacccgccaccgacugcagcgacggcaacuacaaccggaacgccucccucaacagcuucaaggaguacuucaaccuccgcaacugcaccuucauguacaccuacaacaucacggaggacgagauccuggaaugguucgggaucacccagaccgcgcagggcgugcaccucuucagcagccgguacguggaccuguacgggggcaacauguuccaguucgccacccugccggucuacgacacgaucaaguacuacagcaucaucccccacuccauccgcagcauccaguccgaccggaaggccugggccgccuuuuacguguacaagcuccagccccugaccuuccugcucgacuucagcguggacggguacauccgccgagcgaucgauugcggcuucaacgaccugucccaacugcacugcagcuacgaguccuucgacguagagagcggcguguacuccgucagcuccuucgaggcuaagcccagcgggucggucguggagcaggccgagggcguggagugcgauuucagcccguuacuguccgggaccccgccccaggucuacaacuucaagcgccugguguucaccaacugcaacuacaaccucacgaagcugcugagccucuucuccgucaacgauuucacgugcucacagaucagccccgccgccaucgcguccaacugcuacagcagccugauccuggacuauuucagcuacccucucuccaugaaguccgaccugagcgugagcuccgccgggcccaucagccaguucaacuacaagcaguccuucagcaacccgaccugccugauccucgccaccgugccccacaacuuaaccacuaucaccaagccccugaaguacuccuacaucaacaagugcagccggcuccuguccgacgaccgcacugagguuccccagcuggugaacgccaaccaguacagccccugcguguccaucgucccuagcacggugugggaggacggggacuacuaccggaagcaacucagcccgcuggaaggcggcggguggcugguggccuccggcagcaccgucgcgaugaccgagcagcuccagauggguuucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaauuacuacugccugcgggccugcgugagcgugcccgucucagugaucuacgacaaggagacaaagacgcacgccacccuguucgggagcguggccugcgagcacaucuccagcaccaugucccaguacagccgguccacccgcagcaugcucaagcggcgcgacuccacguacggcccgcugcagacccccgucgggugcgugcugggccucgugaacagcucccuguucgucgaggacugcaagcugccacucgggcagagccugugcgcccugcccgacaccccgagcacccucacgcccuga

SEQ ID NO: 2314 - RNA, 2244 nt, Artificial Sequence
  derived and/or modified CDS sequence (opt11) from MERS-CoV__ALJ54512__S1
augauccauagcguuuuccugcucauguucuugcugacccccaccgaguccuacgucgacgugggcccggacagcgugaagucagccugcaucgaggucgacauccaacagacguucuucgacaagaccuggccccgcccgaucgacguuucgaaggccgacgggaucauuuacccccagggccggaccuacuccaacaucacaaucacguaccagggccucuucccguaccaaggcgaccacggggacauguacguguauagcgcgggccacgccaccggcaccacgccccagaagcuguucgucgccaacuacucccaggacgugaagcaguucgccaauggguucguaguccgcaucggcgccgccgccaacagcaccgggaccgugaucaucucccccagcaccuccgcgaccauccgaaagaucuaccccgccuucaugcuggggucuuccguaggcaacuucuccgacggcaagaugggacgcuucuucaaccacacacucguccugcugccggaugggugcggcacccuccugcgggcguucuacugcauccuggagccccgauccggaaaccacugccccgccggcaacagcuacaccuccuucgccacauaccacacgcccgccaccgacugcagcgacggcaacuacaaccggaacgccucccucaacagcuucaaggaguacuucaaccugcgcaacugcacuuucauguacaccuacaacaucacggaggacgaaauccuggagugguucgggaucacccagaccgcgcagggcgcccaccuauucagcucccgguacguggaccuguacggcggcaacauguuccaguucgccacccugccaguguacgacacgaucaaguacuacagcaucaucccucacucaauccgcagcauccagucggacaggaaggcaugggccgcguucuacgucuacaagcuccagccccugaccuuccugcucgacuucagcguggacgguuacauccgccgggccaucgacugcggcuucaacgaccugucccagcugcacuguagcuacgaguccuucgacguggagagcggcguauacuccgugagcuccuucgaggccaagcccagcggguccguggucgagcaggccgagggcguggagugcgacuucagcccgcuccuguccgggaccccgccacagguuuacaacuucaagcgccuagucuucacgaacugcaacuacaaccucacaaaacugcugagccucuucuccgugaacgacuucacgugcagccagaucagccccgccgcgauagcgucaaauugcuauaguuccuugauccuggauuacuucagcuacccgcucuccaugaaguccgaccugagcguuagcuccgccgggcccaucagccaguuuaauuacaagcaauccuucagcaacccgacgugccugauccuugccaccgugccccacaaucugacuaccaucaccaagccccugaaguacucguacaucaacaaaugcagccggcuccuguccgacgaccgcaccgaggugccccaguuggucaacgccaaccaguacagcccgugcguguccauugugcccagcacggucugggaggacggggauuacuaccggaagcagcucagcccgcuggagggcgguggguggcucguggcauccggaagcaccguggccaugaccgagcagcuccagaugggguucggcaucaccguucaguacgggaccgacacuaacuccgugugccccaagcuggaguucgcuaaugacaccaagaucgcgagccagcugggcaacugcguggaguacucccucuauggcgucagcgggcgcgguguguuccagaacugcaccgcgguggggguccgucaacagcgcuucguguacgacgccuaccagaaucuggugggcuauuacuccgacgacggcaacuacuacugcuugcgggccugugucagcguucccguguccgucaucuacgacaaggagaccaagacgcacgccacuuuguucgggagcguggccugcgagcacaucuccagcaccaugucccaguacagccgcuccacccgcagcaugcugaagcggcgcgacuccacguacgggccgcugcagacacccguggggugcguccucgggcucgugaacagcucccuguucguggaggauugcaaacuuccccucgggcagagccucugcgcguugcccgacaccccgagcacccucacgcccuaa

SEQ ID NO: 2315 - RNA, 2244 nt, Artificial Sequence; identical to SEQ ID NO: 1709
  derived and/or modified CDS sequence (opt11) from MERS-CoV__ALJ54517__S1

SEQ ID NO: 2316 - RNA, 2244 nt, Artificial Sequence; identical to SEQ ID NO: 1704
  derived and/or modified CDS sequence (opt11) from MERS-CoV__ALJ54518__S1

SEQ ID NO: 2317 - RNA, 2244 nt, Artificial Sequence; identical to SEQ ID NO: 1711
  derived and/or modified CDS sequence (opt11) from MERS-CoV__ALW82691__S1

SEQ ID NO: 2318 - RNA, 2244 nt, Artificial Sequence; identical to SEQ ID NO: 1712
  derived and/or modified CDS sequence (opt11) from MERS-CoV__ALW82742__S1

SEQ ID NO: 2319 - RNA, 2244 nt, Artificial Sequence; identical to SEQ ID NO: 1698
  derived and/or modified CDS sequence (opt11) from MERS-CoV__ALW82753__S1

SEQ ID NO: 2320 - RNA, 2244 nt, Artificial Sequence; identical to SEQ ID NO: 1714
  derived and/or modified CDS sequence (opt11) from MERS-CoV__ALX27228__S1

SEQ ID NO: 2321 - RNA, 2244 nt, Artificial Sequence
  derived and/or modified CDS sequence (opt11) from MERS-CoV__ALX27232__S1
augauccacagcguguuccuguugauguuccuguuaacccccaccgaguccuacguugacgugggcccggacagcguaaaguccgccugcaucgaggucgacauccagcagacguuuuucgacaagaccuggccccgucccauugacgugagcaaggccgacggaaucaucuacccccagggccggaccuacuccaacaucaccauaacguaccagggccucuucccguaccagggcgaccacggggacauguacguguacagcgcgggccacgccacaggcacuacgccccagaagcuguucgucgccaacuacucgcaggacgugaagcaguucgccaacggguucgugguccgcaucggcgccgcggccaacagcacgggaaccgugaucaucucccccagcaccuccgccaccauccgaaagaucuaccccgccuucaugcugggcagcuccguggggaacuucagcuacggcaagaugggccgcuucuucaaccacacgcucguccugcugccggacgggugcggcacccuccugcgcgcguucuauugcauccuggaaccccgcuccgggaaccacugccccgcgggcaacagcuacaccuccuucgccaccuaccacacgcccgccaccgacugcucugacgguaacuacaaccggaacgccucccucaacagcuucaaggaguacuuuaaccugcgcaacugcaccuucauguacaccuacaauaucacugaggacgagauucuggaaugguucgggaucacccagaccgcgcagggcgugcaccucuucagcucccgguacguggaccuguaugggggcaacauguuccaguucgccacccugccagucuacgacacuauaaaguacuacagcaucaucccacacagcauccgcagcauccaauccgaccggaaggccugggccgccuucuacguguacaagcuccagccccugaccuuccugcucgacuuuagcguggacggguacauccgccgggcgaucgauugcggcuucaacgaccugucccagcugcacugcagcuacgaguccuucgaugucgagagcgguguguacuccguuagcuccuucgaggccaagcccagcggguccgucguggagcaagccgagggcguggagugcgacuucucuccucuccuguccgggaccccgccccaggucuacaacuucaaacgccugguguucaccaacugcaacuacaaccucacgaagcugcugagccucuuuuccgucaacgacuucacgugcagccagaucagccccgccgcaaucgccuccaacuguuacagcagccugauccucgacuacuucagcuacccccucuccaugaaguccgaccugagcgugagcuccgcggggccaaucagccaguucaacuacaaacaguccuucagcaacccaaccugccuuauccucgcgaccgugccacacaaccugaccaccaucaccaagccacugaaguacuccuacaucaauaagugcagccgguuguugucggacgaccgcaccgaggucccccagcugguaaacgccaaccaguacagccccugcguguccaucgugcccagcacggugugggaggacggggacuacuaucggaagcagcucagcccgcuggagggcggcggcuggcucguggccuccggcagcaccguugcgaugaccgagcagcuccagaugggguucgguaucaccgugcaguacgggaccgacaccaacuccgugugccccaagcuggaguucgccaacgacaccaagaucgccagucagcugggcaauugcgucgaguacucccucuacggggugagcgggcgcggcguguuccagaacugcaccgccgucggggugcggcagcagcgcuucguguacgacgcguaccagaaccuggucggcuacuacuccgacgauggcaacuacuacugccugcgggccugcgugagcgugcccgucuccgucaucuacgacaaggagaccaagacgcacgccacgcuuuucgggagcguggccugcgagcacaucucaucuaccaugucgcaauacagccgcuccacccgcagcaugcucaaacggcgugacuccacguacggcccgcuccagacccccgucgggugcgugcugggccucgugaacagcucccuguucgucgaagauugcaagcugccccucggucagagccugugcgcccugcccgacaccccuagcacccucacgcccuga

SEQ ID NO: 2322 - RNA, 2244 nt, Artificial Sequence
  derived and/or modified CDS sequence (opt11) from MERS-CoV__AMQ48993__S1
augauccacagcguguuccugcucauguuccugcugacccccaccgaguccuacgucgaugugggcccggacucagugaaguccgccugcaucgaggucgacauccagcagaccuucuucgacaaaaccuggccccgccccaucgacgugagcaaggccgacgggauuaucuacccccagggccggaccuacuccaacauaaccaucacguaccagggccucuucccguaccagggcgaccacggggacauguacguguacagcgcgggccacgccaccggcaccacgccccagaagcuguucgucgccaacuacucccaggacgugaagcaguucgccaacggguucguuguccgcaucggcgccgcggccaacagcaccgggaccgugaucaucucccccucuaccuccgccaccauccggaagaucuaccccgccuucaugcugggaagcaguguugggaacuucagcgauggcaagaugggccgcuucuucaaccacacgcucguccugcugccggacgggugcggcacccuccugcgggcguucuacugcaucuuagagccccgcuccgggaaccacugccccgccggcaacucauacaccuccuuugccaccuaccacacgcccgccaccgacuguagcgacggcaacuauaaccggaacgccucccucaacucuuucaaggaguacuucaaccugcgcaacugcaccuucauguacaccuacaacaucacggaggacgagauccuggagugguucgggaucacccagaccgcgcagggcguucaccucuucagcucccgguacguggaccuguaugggggcaacauguuccaguucgccacccugccggucuacgacacgauaaaguacuacagcaucaucccccacuccauccgcagcauccagucugaccggaaagccugggccgccuucuacguguacaagcuccagccccugaccuuccugcucgacuucagcguggacgguuacauccgccgagcgaucgacugcggcuucaacgaccuaucacaacugcacugcagcuacgagucauucgacgucgagagcggcguguacuccgugaguuccuucgaggccaagcccagcggauccgucguggagcaggccgagggcguggagugcgacuucucgccgcucuuguccgggaccccgccccaggucuacaacuuuaagcgccugguguucaccaacugcaacuacaaccucacgaagcuguugucucucuucuccgucaacgauuucacgugcagccaaaucucucccgcagccaucgcguccaacuguuacagcagccugauccuggacuacuucagcuacccccucuccaugaagucggaccugagcgugagcuccgccgggcccaucagccaguucaacuacaagcagucauucagcaacccgaccugccugauucucgccaccgugccccacaaccugaccaccaucaccaagccccugaaguacuccuacaucaacaagugcagccggcuccucuccgacgaccggaccgaggucccgcagcuggugaacgccaaccaauacagccccugcguguccaucguccccagcacggugugggaggacggggacuacuaccggaagcaacucucaccgcuggagggcggcggguggcugguggccuccggcagcaucgucgcgaugaccgagcagcuccagaugggguucggcaucaccgugcaguacgggaccgacaccaacuccgugugccccaagcuggaguucgccaacgacacgaagaucgccagccagcugggcaacugcgucgaguacucccucuacggcgugagcggacgcggcguguuucagaacugcaccgccgucggggugcggcagcagcguuucguguacgacgcguaccagaaccuggucgguuacuacuccgacgacggcaacuacuacugccugcgggccugcgugagcgugcccgucuccgugauauacgacaaggagaccaagacccacgccacgcuguuugggagcguugccugcgagcacaucuccagcaccaugucccaguacagccgcaguacccgcagcaugcucaagcggcgugacucaaccuauggcccgcuccagacgcccguugggugcgugcugggccucgugaacagcucccuguuugucgaggacugcaagcugccccuagggcagagccugugcgcccugccagacaccccgagcacccucacgcccuga

SEQ ID NO: 2323 - RNA, 2244 nt, Artificial Sequence
  derived and/or modified CDS sequence (opt11) from MERS-CoV__AMW90844__S1
augauccacagcguguuccugcucauguuccugcugacacccaccgaguccuacgucgacgugggcccggacagcgugaaguccgccugcaucgaggucgacauccagcagacguucuucgacaaaaccuggccccgccccaucgacguuagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucguugcaaacuacucccaggaugugaagcaguucgccaacggauucgugguccgcaucggcgccgcggccaacucaaccgggaccgugaucaucucccccagcaccuccgccaccauccggaagaucuaccccgccuucaugcugggcagcuccguggggaacuucucugacggcaagaugggccgcuucuucaaccacacgcucguccugcugccggacgggugcggcacccuccuucgggcguucuacugcauccuggagccccgcuccgggaaccacugccccgccggcaacagcuacaccuccuucgccaccuaccacacgcccgccaccgacugcagcgacggcaacuacaaccggaacgccucacucaacagcuucaaggaguacuucaaccugcgcaacugcaccuucauguacaccuacaacaucacggaggaugagauccuggagugguucgggaucacccagaccgcgcagggcgugcaccucuucagcucccgguacguggaucuguacgggggcaacauguuccaguucgccacccugccggucuacgacacgaucaaguacuacagcaucauuccgcacuccauccgcagcauccaauccgaccggaaggccugggccgccuuuuacguguacaagcuccagccccugaccuuccugcucgacuucagcguggacggguacauccgccgcgcgaucgacugcggauucaacgaccugucccagcugcacugcagcuacgaguccuuugacgucgagagcggcguguacuccgugagcuccuucgaggccaagcccagcggguccgucguggagcaggcagagggcguggagugcgacuucagcccgcuccuguccgggaccccgccgcaggucuacaacuucaagcgccugguguucaccaacugcaacuacaaucucacgaagcugcugagccucuucuccgucaacgacuucacgugcagccagaucucucccgccgcgaucgcguccaacugcuacagcucccugauccuggacuacuucagcuaccccuuguccaugaaguccgaccugagcgugagcuccgccgggcccaucucccaguucaacuacaagcaguccuucagcaacccgaccugccugauccucgccaccgugccccacaaccugaccaccaucaccaagccccugaaguacuccuacaucaacaagugcagccggcuccuauccgacgaccgcaccgaggucccccagcugguuaacgccaaccaguacagcccuugcguguccaucguccccagcacggugugggaggacggggacuacuaccggaagcaacucagcccgcuggagggcggcggguggcuuguggccuccggcagcaccgucgcgaugaccgaacagcuccagaugggguuuggcaucaccuuccaguacgggaccgacacgaacuccgugugucccaagcuggaguucgccaacgacaccaagaucgccagccagcugggcaacugcguggaguacucccucuacggcgucagcgggcgcggcguuuuccagaacugcaccgccguggggguccggcagcagcgcuucguguacgacgcguaccagaaccuggugggcuacuauuccgacgacggcaacuacuacugccugcgggccugcgucagcgugcccguguccgucaucuacgacaaggagaccaagacgcacgccacccuguucgggagcguggccugcgagcacaucuccagcaccaugucccaguacagccgguccaccagaagcaugcucaagcgacgcgacuccacguacggcccgcugcagacccccgugggguguguccugggccucgugaacagcucccuguucguggaggacugcaagcugccccucggccagagccugugcgcccuacccgacaccccgucuacccucacgcccuga

SEQ ID NO: 2324 - RNA, 2244 nt, Artificial Sequence
  derived and/or modified CDS sequence (opt11) from MERS-CoV__AMW90852__S1
augauccacagcguguuccugcucauguuccugcugacccccaccgaguccuacgucgaugugggcccggacagcgugaaguccgccugcaucgagguagacauccagcaaacguucuucgacaagaccuggccccgccccauagacgugagcaaagccgacgggaucauauacccccagggccggaccuacuccaacaucacaaucacuuaccagggacucuuuccguaccagggggaccacggcgacauguacguguacagcgcgggccacgccaccgguaccacgccacagaaacuguucgucgccaacuacucgcaggacgugaaacaguucgcuaacggauucgugguccgcaucggcgcugcagcuaacagcaccgggaccgugaucaucucccccucaaccuccgccacuauccggaagaucuaccccgccuucaugcugggcagcuccguggguaacuucagcgacggcaagaugggacgcuucuucaaccacacgcucguccugcugccggacgggugcggcacccuccugcgagcguucuacugcauccuggagccccgcuccgggaaucacugccccgcgggcaacagcuacaccuccuucgccaccuaccacacgcccgccaccgacugcagcgacggcaacuacaaucggaacgccucccucaacagcuucaaagaguacuucaaucugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuaugacacgaucaaguacuacagcauaaucccccacuccauccgcucgauccaguccgaccggaaggccugggcagccuucuacguguacaagcuccagcccuuaaccuuccugcuagacuucagcgucgacggguauauccgccgggcgaucgacugcggcuucaacgaccugucccagcugcauugcagcuacgaguccuucgacgucgagagcggcguguauuccguguccuccuucgaggccaagcccagcggguccgucguggagcaggccgagggcguggagugcgacuucagcccgcuccucuccgggaccccgccccaagucuacaacuucaagagacugguguucaccaacugcaacuacaacuucacgaaacuccugagccuguucuccgucaacgacuucacgugcagccagauuagccccgccgcgaucgcguccaacugcuacagcucccucauccuggacuacuucagcuacccccuguccaugaaguccgaucugagcgugagcuccgccgggcccaucagccaauuuaauuacaagcaguccuucucaaacccgacgugccugauccuggccaccgugccccacaaccucacgaccaucaccaagccccugaaguacuccuacauuaacaagugcagccggcugcucuccgacgaccgcaccgaggucccccagcuggugaacgccaaccaguacagccccugcguguccaucguccccuccacagugugggaggacggggacuacuacaggaagcaacugagcccguuagagggcggcggguggcugguggccuccggcagcaccgucgcgaugaccgagcaacugcagaugggguucggcaucacugugcaguacgggaccgacacgaacuccgugugccccaagcucgaguuugccaacgacaccaagaucgccagccagcugggcaacugcgucgaguacucccuguacggcgucuccgggcgcggcguauuucagaacugcaccgccgucggggugcggcagcaacgcuucguguacgacgcguaccagaaucucgugggcuacuacuccgacgacgguaacuacuacugccugcgggccugcgugagcgugcccgucuccgugaucuaugacaaggagaccaagacgcacgccacgcuguucgggagcgucgccugcgagcacauuuccagcaccaugucccaguauagccgcuccacccgcagcaugcugaagcggcgcgauuccacguacgggccgcuccagacgcccgucgggugcguccuuggccuggugaacucgucccucuucguagaagacugcaagcugccucuggggcagagccucugcgcccuucccgacaccccaagcacccugacgccguga

SEQ ID NO: 2325 - RNA, 2244 nt, Artificial Sequence
  derived and/or modified CDS sequence (opt11) from MERS-CoV__AMW90853__S1
augauccacagcguguuccuccucauguuccugcugacccccaccgaguccuacgucgacgugggcagcgacuccgugaaguccgccugcaucgagguggacauccagcagacguucuucgacaagaccuggccgcgccccaucgacguguccaaggcagacgggaucaucuacccucagggccggacguacagcaacaucaccaucacguaccaggggcuguuccccuaccagggcgaccacggggacauguacguguacuccgcgggcuacgccaccggcaccaccccgcagaagcuguucgucgccaacuauagccaggacgugaagcaguucgccaacggguuuguuguccgcaucggcgccgcggccaacuccacggggaccgugaucaucagccccuccaccagcgccaccaucagaaagaucuaccccgccuucaugcugggcuccagcguggggaacuucuccgacggcaagaugggccgcuucuucaaccacacgcucguccugcugcccgacgggugcggcacucuccugcgggcuuucuacugcauccuggagccgcgcagcgggaaccacugccccgccggcaacuccuacaccagcuucgccaccuaccacacgcccgccaccgacugcuccgacggcaacuacaaccggaacgccagccucaacagcuucaaggaauacuucaaccugcgcaacugcaccuucauguacaccuacaacaucacggaggacgagauccuggagugguucggaaucacccagaccgcgcagggcguucaccucuucuccagccgguacguggaccuguacggcggcaacauguuccaguucgccacccugcccgucuacgacacgaucaaguacuacuccaucaucccgcacagcauccgcucaauccagagcgaccggaaggccugggccgccuucuacgucuacaaacuccagccccugaccuuccugcucgacuucuccguggacggguacauccgccgugcgaucgacugcggcuucaacgaccugagccagcugcacugcuccuacgagagcuuugacgucgaauccggcguguacagcguguccagcuucgaggccaagcccuccgggagcgucguggagcaggccgagggcguagagugcgacuucagcccccuccugagcgggaccccuccccaggucuacaacuucaagcgccugguguucaccaacugcaacuacaacuucacaaagcuccugucccuguucagcgucaacgacuucacgugcagccagaucucccccgccgccaucgcuagcaacugcuacuccucucucauccuggacuauuucuccuacccccugagcaugaagucagaccucagcguguccagugccggcccgaucucccaguucaacuacaagcagagcuucuccaacccgaccugccugauucuggccaccgugccccacaaccuuaccaccaucaccaagccccugaaguacagcuacauaaacaagugcucccggcugcucagcgacgaccgcaccgaggucccccaacuggugaacgccaaccaguacucccccugcgugagcaucguccccagcacggugugggaggacggggacuacuaccggaagcagcugagcccacucgagggcggcggguggcugguagccuccggcuccaccgucgcgaugaccgagcagcugcagaugggguucggcaucaccgugcaguacgggaccgacacuaacagcguaugcccgaagcucgaguucgccaacgacaccaagaucgccucccagcugggcaacugcgucgaguacagccuguacggcguguccgggcgcggcguguuccagaacugcaccgccgucggggugcggcagcagcgcuucguguacgaugcguaccagaacuuggucggcuacuacagcgacgacggcaacuacuacugccugcgggccugcguguccgugcccgucagcgugaucuacgacaaggagaccaagacgcacgccacccuguucggguccguggccugcgagcauaucucuucaaccaugagccaguacucccguucgacccgcuccaugcugaagcggcgcgacagcacguacggcccccuccagaccccggucgggugcgugcugggccuggugaacuccucccucuucgucgaggacugcaagcugccacuggggcaaagccucugcgcccugcccgauacccccuccacccugacgccguga

SEQ ID NO: 2326 - RNA, 2244 nt, Artificial Sequence; identical to SEQ ID NO: 1720
  derived and/or modified CDS sequence (opt11) from MERS-CoV__ANC28656__S1

SEQ ID NO: 2327 - RNA, 2244 nt, Artificial Sequence; identical to SEQ ID NO: 1721
  derived and/or modified CDS sequence (opt11) from MERS-CoV__ANC28678__S1

SEQ ID NO: 2328 - RNA, 2244 nt, Artificial Sequence; identical to SEQ ID NO: 1722
  derived and/or modified CDS sequence (opt11) from MERS-CoV__AHL18090__S1

SEQ ID NO: 2329 - RNA, 2244 nt, Artificial Sequence
  derived and/or modified CDS sequence (opt11) from MERS-CoV__AHX00731__S1
augauucacucaguguuccugcucauguuccugcuaacucccacggaguccuacgucgacgucggcccggacagcgugaaguccgccugcaucgaggucgacauccagcaaacguucuucgacaagacauggcccaggcccaucgacgugagcaaggccgacggcaucaucuacccccagggccggaccuacuccaacaucacuauuacguaccagggcuuauucccguaccagggugaccacggggacauguacguguacagcgcgggccacgccaccggcaccacgccccagaagcuguucgucgccaacuacucccaggacgugaagcaguucgccaacggguucgugguccgcaucggcgccgcugccaacagcacuggaaccguaaucaucucccccucgaccuccgcuaccauccggaagaucuaccccgccuucaugcucggcagcuccgucggcaacuucagcgacggcaagaugggccgcuucuuuaaccacacgcucgucuugcugccugacgggugcgggacgcucuugcgggcguucuacugcauccuggagccccgcuccgggaaccacugcccagccggcaacagcuacacuuccuucgccaccuaccacacccccgccaccgacugcagcgacggcaacuacaaucggaacgcgucccucaacagcuucaaagaauacuucaaccugcgcaauugcaccuucauguacaccuacaacaucacagaggacgagauccuggaaugguucgguaucacccagaccgcgcagggagugcaccucuucagcucccgguacguggaccuguacgggggcaacauguuccaauucgccacccugccggucuacgacacgaucaaguauuacagcauaaucccccacuccauccgcagcauccaauccgaucggaaggccugggccgccuucuacguguacaaacuccagccccugaccuuccugcucgacuucagcguggacggguacauccgucgggcgaucgacugcggcuucaacgaccugagccagcuacacugcagcuacgaauccuucgacgucgagagcggaguguacuccgugucuuccuucgaggccaagccgagcggguccgucguggagcaggcugagggcguggaaugcgacuucagcccgcuauuguccgggacgccgccccaaguauacaacuucaagcgacucgucuucacuaacugcaacuacaaccucacgaagcugcugagccuauucuccgucaacgacuucacgugcucccagaucagucccgccgccaucgcguccaacugcuacagcucccugauacuggacuacuucagcuacccccucuccaugaaguccgacuuagggguuagcagcgccgggcccaucucccaguucaacuacaaacagagcuucuccaacccgaccugccugauacucgccacuguaccacacaacuugaccacaauuaccaagccccugaaguacagcuacaucaacaagugcucccggcuccugagcgacgaucgcaccgaagucccccaacuggugaaugccaaccaguauucccccugcgugaguaucgucccguccacggugugggaggauggcgacuacuaccgaaagcagcucagcccgcuggagggcgggggcuggcugguggccagcggguccacggucgcgaugaccgagcagcuccagaugggcuucgggaucacugugcaauacggcaccgacacgaacagcgugugccccaagcuggaguucgcgaacgacaccaagauagcgucccagcuggguaacugcgucgaguacagccucuacggcguguccggccgcgggguguuccagaacugcaccgccgugggcgugcgccagcagcgcuucguguacgacgcguaucagaaccuggucggcuacuacagcgacgacgggaacuacuacugccugcgggccugcgugucagugcccgucagcgugauauacgacaaggagaccaagacgcacgccacccuguucggcuccguggccugcgagcacaucagcuccaccaugucucaguacucccgcagcacccgcuccaugcuaaaacgacgcgacagcacauacgggccacugcagacccccgucggcugcgugcuggggcucgugaacuccagccucuuugucgaggacuguaagcugccccucggccagagccugugcgcgcugcccgauacgccgagcaccuugacgcccuga

SEQ ID NO: 2330 - RNA, 2244 nt, Artificial Sequence; identical to SEQ ID NO: 1724
  derived and/or modified CDS sequence (opt11) from MERS-CoV__AHX71946__S1

SEQ ID NO: 2331 - RNA, 2244 nt, Artificial Sequence; identical to SEQ ID NO: 1725
  derived and/or modified CDS sequence (opt11) from MERS-CoV__AHY22545__S1

SEQ ID NO: 2332 - RNA, 2244 nt, Artificial Sequence; identical to SEQ ID NO: 1726
  derived and/or modified CDS sequence (opt11) from MERS-CoV__AHY22555__S1

SEQ ID NO: 2333 - RNA, 2244 nt, Artificial Sequence; identical to SEQ ID NO: 1727
  derived and/or modified CDS sequence (opt11) from MERS-CoV__AHY22565__S1

SEQ ID NO: 2334 - RNA, 2244 nt, Artificial Sequence; identical to SEQ ID NO: 1728
  derived and/or modified CDS sequence (opt11) from MERS-CoV__AJG44069__S1

SEQ ID NO: 2335 - RNA, 2244 nt, Artificial Sequence
  derived and/or modified CDS sequence (opt11) from MERS-CoV__AJG44080__S1
augauccacagcguguuccugcucauguuccuacugacccccaccgaguccuacgucgacgugggcccggacagcgucaaauccgcaugcaucgaggucgauauccagcaaacguucuucgacaaaaccuggcccagacccaucgacgucagcaaggccgacgggaucaucuacccccaaggucggaccuacuccaacaucacgaucacguaccagggucucuucccguaccagggcgaccacggggacauguacguguacagugcgggccacgccaccggcaccacgccccagaagcuguucguugccaacuacucccaggacguaaagcaguucgccaacgguuucgugguccgcauaggcgccgcggccaacagcaccgggaccguuaucaucucccccagcacuucagcuaccauccggaaaauuuaucccgccuucaugcugggcucaucgguggggaauuucagcgacggcaagaugggccgcuucuucaaccacacgcucguccugcuucccgacgggugcggcacccuccuacgggcauucuacugcauccuggagccccgcuccgggaaccacugccccgccggcaacucguauacauccuucgccaccuaccacacgccagccaccgacugcagcgacggcaauuacaaccggaacgcaucgcucaacuccuucaaggaauacuucaaccugcgcaacugcacguucauguacacauacaacaucacggaggacgagauuuuagagugguucgggauuacccagaccgcgcagggcguccaccuguuuucaucccgguacguggaccuguacgggggcaacauguuccaauucgccaccuuaccugucuacgacaccauaaaguacuacagcaucaucccacauuccauccgcucaauaaaguccgaucggaaagccugggccgccuucuacgucuacaaguugcagccccugaccuuucuguuggacuucagcguggacggguacaucaggcgggcaaucgacugcggcuuuaacgaccugucccagcugcacugcagcuacgaguccuucgacgucgagagcgggguauauuccgugagcuccuuugaggccaagcccagcggauccguuguggagcaggccgaggguguugagugcgacuucagcccacuccugagugggaccccgccccaggucuacaacuucaagcgcuugguguucacgaauugcaacuacaaccucacgaaacugcuaagccucuucucugucaacgauuuuacgugcagccagauuagccccgccgccauugcguccaauugcuacagcucccucauccuagacuauuucagcuacccccucuccaugaagucggaccugagcgugagcucagcagggcccaucagccaguucaacuacaaacaguccuucagcaacccgacgugccugauucucgccaccgugccgcacaaccugacuacgaucacuaagccccugaaguacuccuacaucaacaagugcagccggcugcucucugacgaccgcacugaggucccccagcuggugaacgcgaaccaauacucaccgugcguguccauagugcccagcacggugugggaggacggggacuacuauaggaagcagcucagcccgcuggagggcggcggguggcugguggccuccggcaguacggucgccaugaccgagcagcuccagaugggguucggcaucaccguccaguacgggacugacacgaacuccgugugccccaaguuagaguucgccaacgauacaaagauugcuagccaacucggcaacugcgucgaguacucccucuacggcgugagcgggcguggcguguuccagaacugcaccgccgucgggguacgucagcagcgguucguguacgacgcuuaccagaaccuugucggcuacuacucagacgacggcaacuacuacugcuugcgggcuugcgugagcgugcccgucucggugaucuaugauaaggagaccaagacacaugccacccuguucgggucgguggccugcgagcauaucuccucgaccaugucgcaguacagccgcuccacccgcagcaugcucaagcggcgugacuccacguacggaccgcugcagacccccgucggguguguguugggccucgugaacagcucccuguucgucgaagacugcaagcugccccucgggcaaucgcugugcgcccugcccgacaccccgucuccccucacucccuaa

SEQ ID NO: 2336 - RNA, 2244 nt, Artificial Sequence
  derived and/or modified CDS sequence (opt11) from MERS-CoV__AJG44102__S1
augauccacagcguguuccugcucauguuccugcugaccccaacggaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccuuuucccguaccagggcgaccacggggacauguacguguacucagcgggccacgccaccggcaccacgccacagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguuggaaacuucagcgacggcaagaugggccgcuucuucaaccacacuuugguccugcugccggacgguugcggcacccuccugcgggcguucuacugcauacucgagccccgcuccgggaaccacugccccgccggcaacagcuacaccuccuucgccacguaccacacgcccgccaccgacugcagcgacggaaacuacaaccggaacgccucccucaacagcuucaaggaguacuucaaccugcgcaacugcaccuucauguacaccuacaacaucacggaggacgagauccuggagugguucggaaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaauccgaccggaaggccugggccgccuucuacguguacaagcuccagccccugaccuuccugcucgacuucagcguggacggguacauccgccgggcgauagacugcggcuucaacgaccugucccagcugcacugcagcuacgaguccuucgacgucgagagcggcguguacuccgugagcuccuucgaggccaagccaucaggguccguuguggagcaggccgagggcguggagugcgacuucagcccgcuccuguccgggaccccgccccaggucuacaacuucaagcgccugguguucaccaacugcaacuacaaccucacgaaacuucugagccucuucuccgucaacgacuucacgugcagccagaucagccccgcagccaucgcguccaacugcuacagcucccugauccuggacuacuucucuuacccccucuccaugaaguccgaccuguccgugagcuccgccgggcccaucagccaguucaacuacaagcaguccuucagcaacccgaccugccugauccucgccaccgugucccacaaccugaccaccaucaccaagccacugaaguacagcuacaucaacaagugcucccggcuccugagcgacgaccgcaccgaggucccccagcuggugaacgccaaccaauacucccccugcgugucaaucguccccagcacggugugggaggacggggacuacuaccggaagcagcucagcccccuagagggcggcggguggcugguggccuccggcuccaccgucgcgaugaccgagcagcuccagaugggguucggaaucaccgugcaguacgggaccgauacgaacagcgugugcccgaagcuggaguucgccaacgacaccaagaucgccucccaacugggcaacugcgucgaguacagucucuacggcguguccgggcgcggcguguuccagaacugcaccgccgucgggguucggcagcagcgcuucguguacgacgcguaccagaaccuggucggcuacuacagcgacgacggcaacuacuacugccugcgggccugcguguccguccccgucagcgugaucuacgacaaggagaccaagacgcacgccacccuguucggguccguggccugcgagcacaucagcuccaccaucagccaguacucccgcagcacccguuccaugcucaagcggcgcgacagcacguacggcccccugcagaccccggucgggugcgugcugggccucgugaacuccagccuguucguugaggacugcaagcugccccucgggcaaagccugugcgcccugcccgacacucccuccacccucacgccguga

SEQ ID NO: 2337 - RNA, 2244 nt, Artificial Sequence; identical to SEQ ID NO: 1731
  derived and/or modified CDS sequence (opt11) from MERS-CoV__AJG44124__S1

SEQ ID NO: 2338 - RNA, 2244 nt, Artificial Sequence; identical to SEQ ID NO: 1732
  derived and/or modified CDS sequence (opt11) from MERS-CoV__ALL26396__S1

SEQ ID NO: 2339 - RNA, 2244 nt, Artificial Sequence; identical to SEQ ID NO: 1733
  derived and/or modified CDS sequence (opt11) from MERS-CoV__ALS20350__S1

SEQ ID NO: 2340 - RNA, 2244 nt, Artificial Sequence
  derived and/or modified CDS sequence (opt11) from MERS-CoV__ALT66880__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacguaucuaaggccgacgggaucaucuacccccagggccggaccuacuccaacaucaccaucacguaccagggccucuucccguaccagggcgaccauggggacauguacguguacagcgcgggccacgccaccggcaccacgccccagaagcuguucgucgcgaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccucuuacgggcguucuacugcauccuagagccucgcuccgggaaccacugccccgccggcaacagcuacaccuccuucgccaccuaccacacgcccgccaccgacugcucugacggcaacuacaaccggaacgccucccucaacagcuucaaggaauacuucaacuugcgcaacugcaccuucauguacaccuacaacaucacggaggacgagauccuggaaugguucgggaucacccagaccgcgcagggcgugcaccucuucucuucccgguacguggaccuauacgguggcaacauguuccaauucgccacccugccggucuacgacacgaucaaguacuacagcaucaucccccacuccauccgcagcauccaguccgaccggaaggccugggccgcauucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccucgggguccguaguggagcaggccgagggcguggagugcgacuucucaccgcuccuguccgggaccccgccccaggucuacaacuuuaagcgccugguguucaccaacugcaacuacaaccucacgaagcugcugagccucuuuuccgucaacgacuucacaugcucucagaucucacccgccgccaucgcguccaacugcuacagcucccucauccuggacuacuucagcuacccccucuccaugaaguccgaccugagcgugucauccgccgggcccaucagccaguucaacuacaagcaguccuucagcaacccgaccugccugauccucgccaccgugccccacaaccugacuaccaucacuaagccccugaaguacuccuacaucaacaagugcagccggcuccuguccgacgaccgcaccgaggucccccagcugguuaacgccaaccaguacagccccugcguguccaucguccccagcacggugugggaggacggggacuacuaccggaagcagcucagcccgcuggagggcggcggguggcugguggccuccggcagcaccgucgcuaugaccgagcagcuccagaugggguucggcaucaccgugcaguacgggaccgacaccaacuccgugugccccaagcuggaguucgccaacgacaccaagaucgccagccagcugggcaacugcgucgaguacucccucuacggcgugagcgggcgcggcguguuccagaacugcaccgccguugggguacggcagcagcgcuucguguacgacgcguaccagaaccuggucggcuacuacucugacgacggcaacuacuacugccugcgggccugcgugagcgugcccgucucggugaucuacgacaaggagaccaagacgcacgccacccuguucgggagcguggccugcgagcacaucuccagcaccaugucacaguacucucgcuccacccgcagcaugcucaagcggcgcgauuccaccuacggcccguugcagacccccgucgggugcgugcugggccucgucaacagcucccuguucgucgaggacugcaagcugccccucgggcagagccugugcgcccugcccgacaccccgagcacccucacaccguga

SEQ ID NO: 2341 - RNA, 2244 nt, Artificial Sequence
  derived and/or modified CDS sequence (opt11) from MERS-CoV__ALA49341__S1
augauccacagcguguuccugcucauguuccugcugacccccaccgagucuuacgucgacguagggccggacagcgugaaaucggccugcaucgaggucgacauccagcagaccuucuucgacaagaccuggccacgccccaucgacgugagcaaggccgaugggaucaucuacccccaggggcggaccuauuccaacauaaccaucacguaccagggccuguucccauaccaaggggaccacggggacauguacguguacagcgcgggccacgccaccggcaccacccuacaaaagcuguuugucgccaacuacucccaggacgugaaacaguucgccaauggauuugugguccgcaucggcgccgcggccaacucgacggggaccgugaucaucucccccaguacguccgccaccauccggaagaucuaccccgccuuuaugcucggcaguuccguggggaacuucagcgacggcaagaugggccgcuucuucaaccacacgcuggucuugcuccccgacgggugcggcacccugcugagggcguucuacugcauucucgagccgcgcuccggcaaucacugccccgcuggcaacagcuacaccuccuucgccaccuaucacacgccggccacagacugcagcgacggcaacuacaaccggaacgccucucugaacucauucaaggaguacuucaaccugcgcaacugcaccuucauguauaccuacaacaucacggaggacgagauccucgagugguucgguaucacccagacugcucagggcgugcaccuguucagcucccgauacguggaccuguacgggggcaacauguuccaguucgcaacccuccccgucuacgacacgaucaaguacuacagcauaaucccgcacuccauccguuccauccaguccgaccggaaggcuugggccgccuucuacguguacaagcugcagccccugaccuuucuccuagacuucagcgucgauggguacauccggcgggccaucgacugcggcuucaaugaccugucccagcuccacugcagcuacgaaucuuucgacgucgagagcggcguguacuccgugagcuccuucgaggccaagccuagcggauccgucguggaacaggccgagggcguugagugcgacuucagcccgcuucucuccgggaccccgccccagguuuacaacuucaagcgccucguguucaccaauugcaacuacaaccugacuaaguuacucagccuguucuccgucaacgacuucaucugcagccagauuagccccgccgccaucgcguccaauugcuacagcucgcugauccucgacuauuucucauacccccuguccaugaaguccgaccugagcgugagcuccgccggcccgaucagccaguucaacuacaagcaguccuucagcaaccccacgugccuaauccuggccaccgugccccacaaccuaaccacgaucaccaaacccuuaaaguacucguacauaaacaagugcagccggcugcuguccgacgaccgcacagaggucccccagcucgugaacgcaaaccaguacagccccugcguguccaucguccccagcacugugugggaggacggggacuacuaucgaaagcagcuaagcccccuggagggcggcggguggcucguggccuccggcagcacggucgcgaugaccgagcaacugcagaugggguucggcaucaccgugcaguaugggaccgacaccaacuccgugugcccgaaacuggaguucgccaacgacacgaagaucgccagccagcucggaaacugcgucgaguauucccucuacggcguaagcgggcgcggcguguuccagaacugcaccgccgucggggugcgucagcagcgcuucguguaugaugcguaccaaaaccuggucggcuacuacucugacgacggcaacuacuacugucugcgggccugcgugucggugccagucuccgugauauacgauaaggagaccaagacccacgccacccucuucgggagcguugccugcgagcacaucuccagcaccaugucccaguacagccgcucgacgcgcagcaugcugaagcggcgcgacuccaccuacggcccccuucagacgccggucgggugcgugcucggucuggugaacagcucccuguucgucgaggacugcaagcucccccuggggcagagccugugcgcccuccccgacacccccagcacccugacgccguga

SEQ ID NO: 2342 - RNA, 2244 nt, Artificial Sequence
  derived and/or modified CDS sequence (opt11) from MERS-CoV__ALA49352__S1
augauccacagcguguuccugcucauguuccugcugacccccaccgaguccuacgucgacgugggcccggacagcgugaaguccgccugcauagaggucgacauccagcagacauucuucgacaagaccuggccccgccccaucgacgugagcaaggccgacgggaucaucuacccccagggccggaccuacuccaacaucaccaucacguaccagggccucuucccguaccagggcgaccacggggacauguacguguacagcgcgggccacgccaccggcaccacgccccagaagcuguucgucgcgaacuacucccaggacgugaagcaguucgccaacggguuugugguccgcaucggcgcagcggccaacagcaccgggaccgugaucaucagucccagcaccuccgccacuauccggaagaucuacccagccuucaugcugggcagcuccguggggaacuucagcgacggaaagaugggccgcuucuucaaccacacgcucguccugcugccggacgggugcggcacccuccugcgggcguucuacugcauccuggagccccgcuccggcaaccacugccccgccggcaacagcuacaccuccuucgccaccuacuacacgccagccaccgacugcagugacggcaacuacaaccggaaugccagccucaauagcuucaaggaguacuucaaccugcgcaacugcacguucauguacaccuacaacaucacggaggaugagauccuggagugguucgggaucacccagaccgcgcagggcgugcaccucuucagcucccgguacguggaccuguacgggggcaacauguuccaguucgccacccugccggucuacgacacuaucaaguacuacagcaucaucccccacuccauccgcagcauccaguccgaucggaaggccugggccgccuucuacguguacaagcuccagccccugaccuuccugcucgacuucagcguggacggguacauccgcagagcaaucgacugcggcuucaacgaccugucccaacuacacugcucuuacgaauccuucgaugucgaaagcggaguguacuccgugagcuccuuugaggccaagcccagcggguccgucguggagcaggcugagggcguggagugcgacuucagcccgcuccuguccgggaccccgccccaggucuacaacuucaagcgccugguguucaccaacugcaacuacaacuuaacaaagcugcugagccucuucuccgucaacgacuuuacgugcucacagaucagccccgccgccaucgcguccaacugcuacagcucccugaucuuagacuacuucagcuacccccucuccaugaaguccgaccugagcgugagcuccgccgggcccaucagccaguucaacuacaagcagucguucagcaacccgaccugccugauccucgccaccgugccccacaaccugaccaccaucaccaagccccugaaguacuccuacaucaacaagugcagccgccuccuguccgacgaccgcaccgaggucccccagcuagugaacgccaaccaguacagccccugcguguccaucguccccagcacggugugggaggacggggacuacuaccggaagcagcucagcccgcuggagggcggcggguggcugguggcauccggcagcaccgucgccaugaccgagcagcuucagauggguuucggcaucaccgugcaguacgggaccgauacgaacuccgugugccccaagcuggaguucgccaaugacaccaagaucgccagccagcuggggaacugugucgaguacucccucuacggcgugagcgggcgcgggguguuccaaaacugcaccgccgucggggugcggcagcagcgauucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgaacacaucuccagcacaaugucccaguacucucgcuccacccgcagcaugcucaagcggcgcgacuccacguacggcccgcugcagacccccgucgggugcgugcugggacucguuaacagcagucuguucguagaggacugcaagcugccccucgggcagagccugugcgcccugcccgacaccccgagcacccucacgcccuga

SEQ ID NO: 2343 - RNA, 2244 nt, Artificial Sequence
  derived and/or modified CDS sequence (opt11) from MERS-CoV__ALA49363__S1
augauccacagcguguuccugcucauguuccugcugacucccaccgaguccuacgucgacgugggcccggacagcgugaaguccgccugcaucgaggucgacauccagcagacguucuucgacaagaccuggccccgcccaaucgacgugagcaaggccgacgggaucaucuacccccaaggccggaccuacuccaacaucaccaucacguaccagggccucuucccguaccagggagaccacggugacauguacguguacagcgcgggccacgccaccggcaccacgccccagaagcuguucgucgccaacuacucccaggaugugaagcaguucgccaacggguucgugguccgcaucggcgccgccgccaacucuaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuauugcauccuggagccccgcuccgggaaccacugccccgccggcaacagcuacaccuccuucgccaccuaccacacgcccgccaccgacugcagcgacggcaacuacaaccggaacgccucucucaacagcuucaaggaguacuucaaccugcgcaacugcaccuucauguacaccuacaacaucacggaggacgagauccuggagugguucgggaucacccagaccgcccagggcgugcaccucuucagcucccgguacguggaccuguacgggggcaacauguuccaguucgccaccuucccggucuacgacacgaucaaguacuacagcaucaucccccacuccauccgcagcauccagagcgaccggaaggccugggcagccuucuacguguacaagcugcagccccucaccuuccugcuggacuucagcguggacggguacauccgccgggcaauugacugcggcuucaacgaccucucccagcugcacugcagcuacgaguccuucgacgucgagagcggcguguacuccgugagcuccuucgaggccaagcccagcggguccgucguggagcaagccgagggcguggagugcgacuucagcccgcugcucuccgggaccccgccccaggucuacaacuucaagcgccugguguucaccaacugcaacuacaaccugacgaagcuccugagccuguucagugucaacgacuucacgugcagccagaucagccccgccgccaucgcguccaacugcuacagcucccucauccuggacuacuucagcuacccccuguccaugaaguccgaccucagcgugagcuccgcggggcccaucagccaguucaacuauaagcaguccuucagcaacccgaccugccugauacuggccaccgugccccacaaccucaccaccaucaccaagccccugaaguacuccuacaucaacaagugcagccggcugcucuccgacgaucgcaccgaggucccccagcuggugaacgccaaccaguacagccccuguguguccaucguccccagcacggugugggaggacggggacuacuaccggaagcaacugagcccccucgagggcggcggguggcugguggccagcggcagcaccgucgcgaugaccgagcagcugcaaaugggguucggcaucacggugcaguacgggaccgacacgaacuccgugugccccaagcucgaguucgccaacgacaccaagaucgccagccagcugggcaacugcgucgaauacucccuguacggcgugagcgggcgcggaguguuccagaacugcaccgccgucggggugcggcagcagcgcuucguguacgacgcguaccagaaccucgucggcuacuacuccgacgauggcaacuacuacugccugcgggccugcgugagcgugcccgucuccgugaucuacgacaaggagaccaagacgcacgccacccuguucgggagcguggccugcgagcacaucuccucgaccaugucccaguacagccgcuccacccgaucgaugcugaagcggagagacuccacguacggcccgcuccagacccccgucgggugcgugcugggccugguaaacagcucccucuucgucgaggacugcaagcugccccuggggcagagccucugcgcccugcccgacaccccgagcacccugacgcccuga

SEQ ID NO: 2344 - RNA, 2244 nt, Artificial Sequence
  derived and/or modified CDS sequence (opt11) from MERS-CoV__ALA49374__S1
augauacacuccguguuccugcucauguucuuacugacccccaccgaguccuacgucgacgugggcccggacagcguaaaguccgccugcaucgaggucgacauccagcagacguucuucgacaagaccuggccccgccccaucgacgugucaaaggccgacgggaucaucuacccccagggccggaccuauuccaacaucaccaucacguaucagggccucuucccguaccagggcgaccacggggacauguacguguacagcgcuggccacgccaccggcaccacgccccagaagcuguucgucgccaacuacucccaggacgugaagcaguucgccaacggguucgugguccgcaucggcgccgcggccaacagcaccgggaccgugaucaucucccccagcacuuccgccaccauccggaagaucuacccagccuucaugcugggcuccuccguggggaacuucucugauggcaagaugggccgcuucuucaaccacacgcucguccugcugccggacgggugcggcacccuccuucgggcuuucuacugcauccuagagccccgcuccgggaaccacugccccgccggcaacagcuacaccuccuucgcaaccuaccacacgcccgccaccgacugcagcgacggcaacuacaaccggaacgccucccucaacagcuucaaggaauacuucaaccugcgcaacugcaccuucauguacaccuacaacaucacggaagaugagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcgggguguacuccgugagcuccuucgaggccaagcccagcggguccgucguggagcaggccgaaggcguggagugcgacuuuagcccgcuccuguccgggaccccgccccaggucuacaacuucaaacgccucguguucaccaacugcaacuacaacuucacgaagcuccuaucucuauucuccgucaacgacuucacgugcagccagaucagccccgccgccaucgcguccaacugcuacagcucccucauccuggacuauuucagcuacccccuguccaugaaguccgaccucagcgugagcuccgccgggcccaucagccaguucaacuacaagcaguccuucagcaacccgaccugccugauccuggcuacggugccccacaaccucaccaccaucaccaagccccugaaguacuccuacaucaacaagugcagccggcugcucuccgacgaccgcaccgaggucccccaacuggugaacgccaaucaguacagccccugcguguccaucguccccagcacggugugggaggacggggacuacuaccggaagcagcugagcccguuagagggcggcggguggcugguggccuccggcagcaccgucgcaaugaccgagcagcugcagaugggguucgggaucaccgugcaguacgggaccgacacgaacuccguuugccccaagcucgaguucgccaacgacaccaagaucgccagccagcugggcaacugcgucgaguacucacuguacggcgugagcgggcgcggcguguuccagaacugcaccgccgucggggugcggcagcagcgcuucguauacgacgcguaccagaaccucgucggcuacuacuccgacgacggcaacuacuacugccugcgggccugcgugagcguacccgucuccgugaucuacgacaaggagaccaagacgcacgccacccuguucgggagcguugccugcgagcacaucuccagcacgaugucccaguacagccgcuccacccgcagcaugcugaagcggcgcgacaguacguacggcccgcuccagacccccgucgggugcguacugggccuggugaacagcucccucuucgucgaggacugcaaacugccccuggggcagagccucugcgcccugcccgacacaccgagcacccugacgcccuga

SEQ ID NO: 2345 - RNA, 2244 nt, Artificial Sequence
  derived and/or modified CDS sequence (opt11) from MERS-CoV__ALA49396__S1
augauccacagcguguucuuacucauguucuuacugacucccaccgaguccuacgucgacguaggcccggacagugugaagucagccugcaucgagguagacauccaacagacguucuucgacaagaccuggccccgccccauagacgugagcaaggccgacgggauuauuuauccccaggggcggaccuacucaaacaucaccaucacguaccagggucuuuucccguaccagggcgaccacggggauauguacguguacagcgcgggccacgcuaccggcaccacgccccagaagcuguucgucgccaacuacucccaggacgugaagcaguucgccaacggguucgugguacgcaucggcgccgcggccaauagcacggggaccgucaucaucucacccagcaccuccgccaccauacggaagaucuaccccgccuucaugcuggggucuuccgugggcaacuucucugacggcaagaugggccgcuucuucaaccacacgcucgugcugcugccggacgggugcggcacccuccugcgggcguucuacugcauccuggagccccgcuccgggaaucacugccccgccggcaacagcuacaccuccuucgccacguaucacacgccggccaccgacuguuccgacggaaacuacaaccggaacgccucccucaacagcuucaaagaauacuuuaacuugcggaacugcacauucauguacaccuauaacaucacggaggacgagauccuggaaugguucgggaucacccaaaccgcacagggcgugcaccucuucagcagccguuacguggaccuguacgggggcaacauguuccaguucgcuacauugccggucuacgacacuauaaaguacuacagcauaaucccccacucgaucaggucgauccagucugaucggaaggccugggcagcauucuacguauacaagcugcagcccuuaaccuuccuguuagacuucagcguggacgguuacaucagacgggcuaucgacugcggcuucaacgaccugucgcaauuacacuguagcuacgaauccuucgacgucgagucgggaguguacucggugucaaguuucgaggccaagcccagcgggucugucguggaacaggccgagggcguggagugcgacuucagcccgcuauuauccgggacgccuccccaggucuauaacuuuaagcgccugguguucacaaacugcaacuacaaccucacgaaacugcuguccuuauuuuccgucaacgacuucacgugcucucagaucagccccgccgcaaucgcguccaacugcuacagcucccugaucuuggacuacuucagcuauccccucucuaugaaauccgaccugagcgugagcuccgccgggcccaucagccaguucaacuacaagcaauccagcucaaacccgacaugcuuaauauuagccacagugccccacaaccugaccaccaucaccaagccgcugaaguauagcuacaucaacaagugcucccgccuccugagcgacgaccgcaccgagguaccccagcuggugaacgcgaaccaguacuccccgugcguuaguaucguacccucaacggucugggaggacggggacuacuaccggaaacagcucagcccgcuggaggguggcgggugguuggucgcaagcggcagcacagucgcgaugaccgagcagcuccagaugggauucggcauaaccgugcaguacgggaccgacacgaacagcgugugccccaagcuggaguucgccaacgacacgaaaaucgccucccagcugggcaauuguguagaguauuccuuauacggcguguccgggcgcgguguuuuccagaacugcacggccgucggggugcggcagcagcgcuucgucuacgacgcguaccaaaaccuggucggcuacuacagcgacgacggcaacuacuauugccugcgggccugcguguccguccccgucagcgugaucuacgacaaggagaccaaaacgcacgccacccuguucggguccguagccugugagcacaucagcucaacuaugagccaguacucccgcagcacccgcuccaugcuuaaacggcgcgacagcacguacgguccgcuccagacccccgucgggugcgugcuaggucucgucaauuccagccuguucguggaggacuguaagcugccauuggggcagagucugugcgccuuacccgacaccccguccacccucacgcccuga

SEQ ID NO: 2346 - RNA, 2244 nt, Artificial Sequence; identical to SEQ ID NO: 1740
  derived and/or modified CDS sequence (opt11) from MERS-CoV__ALA49451__S1

SEQ ID NO: 2347 - RNA, 2244 nt, Artificial Sequence; identical to SEQ ID NO: 1741
  derived and/or modified CDS sequence (opt11) from MERS-CoV__ALA49473__S1

SEQ ID NO: 2348 - RNA, 2244 nt, Artificial Sequence
  derived and/or modified CDS sequence (opt11) from MERS-CoV__ALA49583__S1
augauucacagcguguuccugcucauguuucugcugacccccaccgaguccuacgucgacgucggcccagacagcguaaaguccgccugcaucgaggucgacauccagcagacguucuucgacaagaccuggccacgcccgauugacgugagcaaggccgacgggaucaucuacccucagggacggaccuacuccaacaucacgaucacguaccagggccucuucccuuaucagggugaccacggcgacauguacguguacagcgcgggccacgccaccggcaccacgccccagaagcuguucgucgcgaacuacucccaggacguuaagcaguucgccaacggguucgugguccgcaucggcgccgcggccaacucaaccgggaccgugaucaucucccccagcaccuccgccaccauccguaagaucuaccccgcauucaugcugggcagcuccguggggaauuucagcgacggcaaaaugggcagguucuucaaccacacacucguccugcugccggacggcugcggcacccuccugcgggcguucuacugcauccuggagccccgcuccgggaaccacugccccgccggcaacucauacaccuccuuugccaccuaccauacgccggccaccgacugcagcgacggcaacuauaaccggaacgccucccucaacagcuucaaggaguacuucaaccugcgcaacugcaccuucauguacaccuacaacaucacggaggacgagauccuggagugguucgggaucacccaaaccgcgcagggcgugcaccucuucagcucucgguacguggaccuguacgggggcaacauguuucaguucgccacacugccgguauacgacacgauuaaguacuacucaaucaucccacacuccauccgcagcauccagucugaccggaaggcgugggccgccuucuacguguacaagcuccagccacugaccuuccugcucgacuucagcguggacggguacauccgccgggcgaucgacugcggcuucaacgaccugucccagcugcacugcagcuaugaguccuucgacgucgagucuggcguguacuccgugagcuccuucgaggccaaaccgucuggguccgucguggagcaggccgagggcguggagugcgacuucagcccccuccuguccgggaccccgccccaggucuacaacuucaagcgccugguguucaccaacugcaacuauaaucucacgaagcugcugucccucuucuccgucaaugacuucacaugcagccagaucagccccgccgccaucgcguccaacugcuacagcucccugauccuggacuacuucagcuauccccucuccaugaaguccgaccugagcgucagcuccgccgggccgaucagccaguucaacuacaagcaguccuucuccaacccgaccugccugauccucgccaccgugccccacaaccugaccacgaucaccaagccccugaaguauuccuacaucaacaaguguagccggcuccugagugacgaccgcaccgagguuccccagcuggugaacgccaaccaguacagccccugcguauccaucguccccagcacgguaugggaggacggggacuacuaccggaagcagcucagcccgcuggagggcggcggguggcuuguggccuccgggagcaccgucgcgaugaccgagcaacuccagaugggcuucggcaucaccgugcaguacgggaccgacacgaacuccgugugcccaaagcuggaguucgccaacgacaccaagaucgccagccagcugggcaacugcgucgaguacucacucuacggcgugagcgggcgcggcgucuuucaaaacugcaccgccgucggcgugcggcagcagcgcuuuguguacgacgcguaucagaaccuggucggcuacuacuccgacgacggcaacuacuacugccugcgggccugcgugagcgugcccgucagugucaucuaugacaaggagaccaagacccacgcuacacuguuugggagcguggccugcgagcacauuuccagcaccaugucccaguacagccgcuccacccgcagcauguugaagcggcgcgauuccacguacggcccgcugcagacccccgucgggugcgugcuuggccucgugaacagcucccuguucgucgaggacugcaaacugccccucgggcagucucugugcgcucugccugacacuccgaguacccucacgcccuga

SEQ ID NO: 2349 - RNA, 2244 nt, Artificial Sequence; identical to SEQ ID NO: 1743
  derived and/or modified CDS sequence (opt11) from MERS-CoV__ALA49649__S1

SEQ ID NO: 2350 - RNA, 2244 nt, Artificial Sequence
  derived and/or modified CDS sequence (opt11) from MERS-CoV__ALA49660__S1
augauacacagcguguuccugcucauguuccugcuuacccccaccgaauccuaugucgaugugggcccggacagcgugaaguccgccugcaucgaggucgacauccagcagacuuucuucgacaagaccuggccccgccccaucgacgugagcaaggccgacgggaucaucuacccccaggggaggaccuacuccaacaucaccaucacguaccagggccucuucccguaccagggcgaccacggggacauguacguguauagcgcgggccacgccaccgguaccacgccccagaaacuguucgucgccaacuacucccaggacgugaagcaguucgcgaacggauucguaguccgcaucggcgccgcggccaacagcaccgggacggugauaaucuccccaucaaccuccgccaccauccggaaguucuaccccgcuuucaugcugggcagcuccguggggaacuucagcgacgggaagauggggcgcuuuuucaaccacacacucguccugcugccggacgggugcggcacccucuugcgggcguucuacugcauccuggagccccgcuccgggaaucacugccccgccggcaauucauacaccuccuucgccacuuaccacacgcccgccaccgacugcagcgacggcaacuacaaccggaacgccagccucaacagcuucaaggaguauuucaaucugcgcaacugcaccuucauguacacauacaauaucacggaggacgagauccuggagugguucgggaucacucagaccgcccagggcgugcaccucuuuaguucccgguacguagaccuguacgggggcaauauguuccaguucgccacccugccgguuuacgacacgaucaaguacuacagcaucaucccccacuccauucgcagcauccaguccgaccggaaggccugggccgccuucuacgucuacaagcuccagccccucacguuccugcucgacuucucaguggacggguacauccgccgggcgaucgacugcgguuucaacgaccugucccagcugcacugcagcuacgaguccuucgacgucgagucgggcguguacuccgugagcuccuucgaggccaagcccagcgguuccgucguggagcaggccgagggcguggagugcgacuucagcccgcuccuguccgggaccccgccccaggucuauaacuucaagcgccugguguucaccaacugcaauuacaaccucacgaagcugcugagcuuauucucagucaacgauuucacgugcagccagaucagccccgccgccaucgcgagcaacugcuacuccucccugaucuuggacuauuucagcuaucccuuaagcaugaaguccgacuugucugugagcuccgccgggcccaucagccaguucaacuacaagcaguccuucagcaacccgaccugccugauccucgccaccgugccucacaacuuaaccacuauuaccaagccacugaaguauuccuacaucaacaagugcucucggcugcuguccgacgaccgcaccgaggucccccagcuggugaacgccaaccaguacagccccugugugagcaucguccccagcacggugugggaggacggagauuacuacagaaagcagcucagcccucuggagggcggcggguggcugguggccuccggcuccaccgucgcgaugaccgagcagcuccagaugggguucggcaucaccgugcaguacgggaccgacacgaacuccgugugccccaagcuggaguucgccaacgacacuaagaucgccucccagcugggcaacugcgucgaguacucccucuacggcgugagcgggaggggcguguuccagaauugcaccgccgucggggugcggcagcagcgcuucguguaugacgccuaccagaacuugguaggcuacuacuccgacgacggcaacuacuacugucugcgggccugcgugucaguaccaguuuccgugaucuacgacaaggagaccaagacgcacgccacccuguucgggagcguggccugugagcacaucuccaguaccaugucccaguacagccguuccacccgcagcaugcucaagcggcgcgacuccaccuacggcccgcugcagacccccgucgggugcgugcugggccucgucaauucguccuuauucguggaggacugcaagcugccacucggucagucccugugcgcccugcccgacaccccgagcacccucacucccuga

SEQ ID NO: 2351 - RNA, 2244 nt, Artificial Sequence; identical to SEQ ID NO: 1745
  derived and/or modified CDS sequence (opt11) from MERS-CoV__ALA49671__S1

SEQ ID NO: 2352 - RNA, 2244 nt, Artificial Sequence; identical to SEQ ID NO: 1650
  derived and/or modified CDS sequence (opt11) from MERS-CoV__ALA49682__S1

SEQ ID NO: 2353 - RNA, 2244 nt, Artificial Sequence
  derived and/or modified CDS sequence (opt11) from MERS-CoV__ALA49803__S1
augauccacagcguguuccuacucauguuccugcucacccccaccgaguccuacgucgacgugggcccggacagcgugaaauccgccugcaucgaggucgacauccagcagacguucuucgacaaaaccuggccgcgucccaucgacguuagcaaggccgacgggaucaucuauccccagggccggaccuacuccaauaucaccaucacguaucagggccucuuucccuaccagggcgaccacggggaucgcuacguguacagcgcgggccacgccaccggcaccacgccccagaagcuguucgucgccaacuacucccaggacgugaagcaguucgccaacggguucguuguccggaucggcgccgcggcuaacagcaccgggaccgugauuaucucccccagcaccuccgccaccaucaggaagaucuaucccgccuucaugcugggcagcuccguugggaacuucagcgauggcaagaugggccgguucuucaaccacacgcucgugcugcuaccggacgggugcggcacccucuugcgcgcuuucuacugcauccuggagccccgguccgggaaccacugcccugccggcaacagcuacaccucauucgccaccuaccacacgcccuccacugacugcuccgacggcaacuacaaccgcaacgccagccucaauagcuucaaggaguacuucaaccugcggaacugcaccuucauguacaccuacaacaucacggaggacgagauccuggagugguuuggaaucacccagaccgcccagggugugcaccucuucuccucacgcuacguggacuuguacgggggcaacauguuccaauucgcgacccugccggucuacgacacgaucaaguacuacuccaucaucccccacagcauccguuccauccagagcgacaggaaggcgugggccgccuuuuacguguacaagcuccaaccccugaccuuccugcucgacuucuccguggacgguuacauccggcgcgccaucgacugcggcuucaacgaccugagccaguugcacugcuccuacgagaguuuugacgucgaguccggaguguacagcguguccagcuuugaggcgaagcccuccgggagcgucguggagcaggccgagggcguggagugcgacuucagcccgcuccugagcgggaccccgccccaggucuacaacuucaagcggcugguuuucacuaacugcaacuacaaccucacgaagcugcugucccucuucagcgucaacgacuucacgugcucucagaucuccccugccgccaucgccagcaacugcuacaguagccugauccuggacuacuucaguuacccccucagcaugaaguccgaccuuagcguguccagcgcggggcccaucucccaguucaacuacaagcaauccuucuccaacccgaccugccugauccucgccaccgucccccacaaccugaccaccauaacaaagccccugaaguacagcuacauuaacaaguguucccgccucuugagcgacgaccggaccgaggucccccagcuggugaacgccaaccaguacucccccugcgugucuaucguccccagcacggugugggaggacggugacuacuaccgcaaacagcucagcccacuggaaggcgggggaugguuaguggccagcggcuccaccgucgccaugaccgagcagcuccagaugggguucggcaucaccgugcaguacgggaccgacacgaacagcgugugccccaagcuggaguucgcgaacgauaccaagaucgccucccagcugggcaacugcguagaguacagccucuacggcguguccgggcggggcguauuccagaacugcaccgccgucggggugaggcagcaacgguucguauacgacgccuaccagaaccucgucggcuacuacagcgacgacggcaacuacuacugcuuacgcgcuugcguguccguucccgucagcgugauauaugacaaggagaccaagacgcacgccacccucuucggguccguggccugcgagcacaucagcuccaccaugucccaguacucccgcagcacccgguccaugcucaagcgccgggacagcacguacggcccgcuacagacccccgucgggugcguguugggccucgugaauagcagccuguucgucgaggacugcaagcucccccucgggcaaagccugugcgcccugcccgacaccccguccacccucacgcccuaa

SEQ ID NO: 2354 - RNA, 2244 nt, Artificial Sequence
  derived and/or modified CDS sequence (opt11) from MERS-CoV__ALA49836__S1
augauccacuccguguuccugcucauguuccucuuaacccccacagaguccuacguagacgugggcccagacagcgugaaauccgccugcaucgaggucgacauccagcagaccuucuucgacaagaccuggccccgccccaucgacgugagcaaagccgacgguaucaucuacccccagggcagaaccuacuccaacaucaccaucacguaccagggccucuucccguaccagggcgaccacggggacauguacgucuacagcgcaggccacgccaccggcaccacgccccagaagcuguuugucgccaacuacucccaggacgugaaacaguucgccaacggguucgugguccgcaucggcgccgcggccaacagcaccggaacagugaucaucagccccagcaccagcgccaccauccggaagaucuaccccgccuucaugcugggcagcuccguggggaacuucagcgacggcaagaugggccgcuucuuuaaccacacgcucgucuuacugcccgaugggugcggcacccuucugagggcguucuacugcauccuggagccgcgcuccgggaaccacugccccgccggcaacucuuacaccuccuucgccaccuaccacacucccgccaccgacugcagcgacggcaacuacaaucggaacgccucccucaacagcuucaaggaguacuucaaccugcgcaacugcaccuucauguauacguacaacaucacggaagacgagauccuggagugguucgggauuacccagaccgcgcagggcgugcaccucuucagcagccgguacguggaccuguacggaggcaauauguuccaguucgccacccugccggucuacgacacgaucaaguacuacagcaucaucccccacuccauccgcagcauccaguccgaccggaaagccugggccgccuucuacguguacaagcuccagccccugaccuuccugcucgacuucagcguggacggguacauccgccgggcaaucgacugcggcuucaacgaccugucccagcugcauugcagcuacgaguccuucgacgucgagagcggcguguacuccgugaguucuuucgaggccaagcccagcggguccgucguggagcaagccgagggcguggagugcgauuuuagcccgcuccuguccgggaccccgccacaggucuacaacuucaagcgccugguguucaccaacugcaacuacaaccucacaaaacugcugagccucuucuccgucaacgacuucacgugcagccagaucagccccgccgccaucgcgucaaacugcuacagcucccugauccuagacuacuucucauacccccucuccaugaagucugaccugucggugagcucugccgggccgaucagccaguucaacuacaagcaguccagcuccaacccgacgugccugauccucgccaccgucccccacaaccugacgaccaucaccaagccccugaaguacagcuacaucaacaaaugcucccggcuccugucagacgaccgcacagaggucccccagcuggugaacgccaaccaguacucccccugcgugagcaucguccccagcacugugugggaggacggggacuacuaccggaagcaacucuccccgcuggagggcggcggguggcugguggccagcggcuccaccguugcgaugaccgaacaacuccaaaugggguuuggcaucaccgugcaauacgggaccgacacgaacagcgugugccccaagcucgaguucgccaaugacaccaagaucgccucccagcugggcaacugcgucgaguacagccucuauggcguguccggccggggcguguuccagaacugcaccgccgucggcgugcggcagcagagguuuguguacgacgcguaccagaaccuggucggcuacuacucugacgacggcaacuacuacugccugcgggccugcgugucugugcccgucagcgugaucuacgacaaggagaccaagacgcacgccacucuguucggguccguggccugcgagcacaucucauccaccaugagccaguacucccgcagcacccgcaguaugcucaagcggcgcgacagcacguacggcccauugcagacccccgucgguugcgugcugggccucgugaacuccagccuguucgucgaggacugcaagcugccccucgggcagagccugugcgcccugcccgacacccccuccacccucacgcccuga

SEQ ID NO: 2355 - RNA, 2244 nt, Artificial Sequence; identical to SEQ ID NO: 1650
  derived and/or modified CDS sequence (opt11) from MERS-CoV__ALA49957__S1

SEQ ID NO: 2356 - RNA, 2244 nt, Artificial Sequence
  derived and/or modified CDS sequence (opt11) from MERS-CoV__ALA50067__S1
augauccacagcguguuccugcucauguuccuccucacccccaccgaguccuacguugacgugggcccggacagcgugaaguccgccugcaucgaggucgacauacagcagacguucuucgacaagaccuggccccgccccaucgacgugagcaaggcggacgggaucaucuacccccaaggccggaccuacuccaacaucaccaucacguaccagggccucuucccguaccagggcgaccacggggacauguauguguacagcgcgggccacgccaccggcaccacgccccagaagcuguucgucgccaacuacucccaggacgugaagcaguucgccaacggguucgugguccgcaucggcgccgcugccaacagcaccggcaccgugaucaucucccccagcaccagcgccaccauccggaagaucuaccccgccuucaugcugggcucguccguggggaacuucagcgacgguaagaugggccgcuucuucaaccacacgcucguccugcugccggacgguugcggcacccuccugcgggcguucuauugcauccuggagccccgcuccgggaaccacugccccgccgggaacagcuacaccuccuucgccaccuaucacacgcccgcuaccgacugcagcgacgguaacuacaaccggaacgccucacucaacagcuucaaggaguacuucaaccugcgcaacugcaccuucauguacaccuacaacaucacggaagacgaaauccuggagugguuugggaucacccagaccgcccaaggcgugcaccucuucagcucccgguacguggaccuguacggugggaacauguuucaguucgccacccugccagucuacgacacgaucaaguacuacagcaucaucccccacuccauccgcagcauccaauccgacagaaaggccugggccgccuucuacguguacaaacuccagccccugaccuuccugcucgacuucucaguagauggguacauccgccgggcgaucgauugcgguuucaacgaccugucccagcugcacugcagcuacgagucguucgacgucgagagcggcguguacuccgugagcuccuucgaggccaagcccagcggauccgugguggagcaggccgagggcguggagugcgacuucagcccucuccuguccgggaccccgccucaagucuacaauuucaagcgccugguguucaccaacugcaacuacaacuugacgaagcugcugagccucuucucagugaacgacuucacgugcagccagaucagccccgccgcaaucgcgucuaauugcuacagcucccugauccuggacuacuuuagcuacccccucuccaugaaaagcgaccugagugugagcagcagcgggcccaucucgcaauucaacuacaagcagagcuucuccaacccgaccugccugauccucgccaccgugccucacaaccugacgaccaucaccaagccccugaaguacagcuacaucaacaagugcagccggcuccugagcgacgaccgcaccgaggugccccagcuggugaacgccaaccaguacucgcccugcgugagcaucguccccagcacggugugggaggacggggacuauuaccggaagcagcucuccccgcuggagggcggcggguggcugguggccagcggauccacggucgccaugaccgagcagcuccagaugggcuucggcaucaccgugcaauacgggaccgacacgaacagcgugugccccaagcuggaguucgcgaacgacacaaagaucgccucucagcugggcaacugcgucgaauacagccucuacggcguguccgggcgcggcguguuccagaacugcaccgcggucggggugcgucagcaacgcuucguguacgaugccuaccagaaccuggucggcuacuacagcgacgacgggaacuacuacugccugcgggcgugcguguccgugcccgucagcgugaucuacgauaaggagaccaagacccacgccacccuguucggaucaguagccugcgagcacaucagcuccaccaugagccaguacucccgcaguacccgcuccaugcugaagcggcgcgacagcacguacggcccgcugcagacccccgucggguguguccucggccucguaaacuccagccuguucgucgaggacugcaagcugccccucgggcagagccugugcgcccugcccgacaccccuuccacccucacgcccuga

SEQ ID NO: 2357 - protein, 1353 aa, Artificial Sequence
  derived and/or modified protein sequence (wt) from MERS-CoV__AHI48605__S(V1060P,K1061P)
MIHSVFLLMFLLTPTESYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDPPEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 2358 - protein, 1354 aa, Artificial Sequence
  derived and/or modified protein sequence (wt) from MERS-CoV__AHI48605__HsIgE(1-18)_S(18-1353)
MDWTWILFLVAAATRVHSYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDVLEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 2359 - protein, 1354 aa, Artificial Sequence
  derived and/or modified protein sequence (wt) from MERS-CoV__AHI48605__HsIgE(1-18)_S(18-1353,V1060P,K1061P)
MDWTWILFLVAAATRVHSYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTPRSVRSVPGEMRLASIAFNHPIQVDQLNSSYFKLSIPTNFSFGVTQEYIQTTIQKVTVDCKQYVCNGFQKCEQLLREYGQFCSKINQALHGANLRQDDSVRNLFASVKSSQSSPIIPGFGGDFNLTLLEPVSISTGSRSARSAIEDLLFDKVTIADPGYMQGYDDCMQQGPASARDLICAQYVAGYKVLPPLMDVNMEAAYTSSLLGSIAGVGWTAGLSSFAAIPFAQSIFYRLNGVGITQQVLSENQKLIANKFNQALGAMQTGFTTTNEAFHKVQDAVNNNAQALSKLASELSNTFGAISASIGDIIQRLDPPEQDAQIDRLINGRLTTLNAFVAQQLVRSESAALSAQLAKDKVNECVKAQSKRSGFCGQGTHIVSFVVNAPNGLYFMHVGYYPSNHIEVVSAYGLCDAANPTNCIAPVNGYFIKTNNTRIVDEWSYTGSSFYAPEPITSLNTKYVAPQVTYQNISTNLPPPLLGNSTGIDFQDELDEFFKNVSTSIPNFGSLTQINTTLLDLTYEMLSLQQVVKALNESYIDLKELGNYTYYNKWPWYIWLGFIAGLVALALCVFFILCCTGCGTNCMGKLKCNRCCDRYEEYDLEPHKVHVH

SEQ ID NO: 2360 - protein, 748 aa, Artificial Sequence
  derived and/or modified protein sequence (wt) from MERS-CoV__AHI48605__HsIgE(1-18)_S(18-747)
MDWTWILFLVAAATRVHSYVDVGPDSVKSACIEVDIQQTFFDKTWPRPIDVSKADGIIYPQGRTYSNITITYQGLFPYQGDHGDMYVYSAGHATGTTPQKLFVANYSQDVKQFANGFVVRIGAAANSTGTVIISPSTSATIRKIYPAFMLGSSVGNFSDGKMGRFFNHTLVLLPDGCGTLLRAFYCILEPRSGNHCPAGNSYTSFATYHTPATDCSDGNYNRNASLNSFKEYFNLRNCTFMYTYNITEDEILEWFGITQTAQGVHLFSSRYVDLYGGNMFQFATLPVYDTIKYYSIIPHSIRSIQSDRKAWAAFYVYKLQPLTFLLDFSVDGYIRRAIDCGFNDLSQLHCSYESFDVESGVYSVSSFEAKPSGSVVEQAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSLYGVSGRGVFQNCTAVGVRQQRFVYDAYQNLVGYYSDDGNYYCLRACVSVPVSVIYDKETKTHATLFGSVACEHISSTMSQYSRSTRSMLKRRDSTYGPLQTPVGCVLGLVNSSLFVEDCKLPLGQSLCALPDTPSTLTP

SEQ ID NO: 2361 - RNA, 4062 nt, Artificial Sequence
  derived and/or modified CDS sequence (opt1) from MERS-CoV__AHI48605__S(V1060P,K1061P)
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 2362 - RNA, 4065 nt, Artificial Sequence
  derived and/or modified CDS sequence (opt1) from MERS-CoV__AHI48605__HsIgE(1-18)_S(18-1353)
auggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 2363 - RNA, 4065 nt, Artificial Sequence
  derived and/or modified CDS sequence (opt1) from MERS-CoV__AHI48605__HsIgE(1-18)_S(18-1353,V1060P,K1061P)
auggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 2364 - RNA, 2247 nt, Artificial Sequence
  derived and/or modified CDS sequence (opt1) from MERS-CoV__AHI48605__HsIgE(1-18)_S(18-747)
auggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 2365 - RNA, 4062 nt, Artificial Sequence
  derived and/or modified CDS sequence (opt1) from MERS-CoV__AHI48605__S
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacuga

SEQ ID NO: 2366 - RNA, 2244 nt, Artificial Sequence
  derived and/or modified CDS sequence (opt1) from MERS-CoV__AHI48605__S1
augauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccuga

SEQ ID NO: 2367 - RNA, 4279 nt, Artificial Sequence
  mRNA product Design1 comprising derived and/or modified sequence from MERS-CoV__AHI48605__S(V1060P,K1061P) (opt1)
gggagaaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2368 - RNA, 4282 nt, Artificial Sequence
  mRNA product Design1 comprising derived and/or modified sequence from MERS-CoV__AHI48605__HsIgE(1-18)_S(18-1353) (opt1)
gggagaaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2369 - RNA, 4282 nt, Artificial Sequence
  mRNA product Design1 comprising derived and/or modified sequence from MERS-CoV__AHI48605__HsIgE(1-18)_S(18-1353,V1060P,K1061P) (opt1)
gggagaaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2370 - RNA, 2464 nt, Artificial Sequence
  mRNA product Design1 comprising derived and/or modified sequence from MERS-CoV__AHI48605__HsIgE(1-18)_S(18-747) (opt1)
gggagaaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2371 - RNA, 4279 nt, Artificial Sequence
  mRNA product Design1 comprising derived and/or modified sequence from MERS-CoV__AHI48605__S (opt1)
gggagaaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2372 - RNA, 2461 nt, Artificial Sequence
  mRNA product Design1 comprising derived and/or modified sequence from MERS-CoV__AHI48605__S1 (opt1)
gggagaaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2373 - RNA, 4444 nt, Artificial Sequence
  mRNA product Design2 comprising derived and/or modified sequence from MERS-CoV__AHI48605__S(V1060P,K1061P) (opt1) R6174/R6180
ggggcgcugccuacggagguggcagccaucuccuucucggcaucaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2374 - RNA, 4447 nt, Artificial Sequence
  mRNA product Design2 comprising derived and/or modified sequence from MERS-CoV__AHI48605__HsIgE(1-18)_S(18-1353) (opt1) R6176/R6182
ggggcgcugccuacggagguggcagccaucuccuucucggcaucaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2375 - RNA, 4447 nt, Artificial Sequence
  mRNA product Design2 comprising derived and/or modified sequence from MERS-CoV__AHI48605__HsIgE(1-18)_S(18-1353,V1060P,K1061P) (opt1) R6177/R6183
ggggcgcugccuacggagguggcagccaucuccuucucggcaucaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacccgcccgagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2376 - RNA, 2629 nt, Artificial Sequence
  mRNA product Design2 comprising derived and/or modified sequence from MERS-CoV__AHI48605__HsIgE(1-18)_S(18-747) (opt1) R6178/R6184
ggggcgcugccuacggagguggcagccaucuccuucucggcaucaagcuuaccauggacuggaccuggauccuguuccucguggccgccgcgacccgcguccacagcuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2377 - RNA, 4444 nt, Artificial Sequence
  mRNA product Design2 comprising derived and/or modified sequence from MERS-CoV__AHI48605__S (opt1) R6173/R6179
ggggcgcugccuacggagguggcagccaucuccuucucggcaucaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgccccgguccgugcgcagcgugcccggcgagaugcggcuggcguccaucgccuucaaccaccccauccaggucgaccagcugaacagcuccuacuucaagcucagcaucccgaccaacuucuccuucggcgugacccaggaguacauccagaccacgauccagaaggugaccgucgacugcaagcaguacgugugcaacggguuccagaagugcgagcagcugcugcgcgaguacggccaguucugcagcaagaucaaccaggcccuccacggggccaaccugcggcaggacgacuccgugcgcaaccuguucgccagcgucaaguccagccaguccagccccaucauccccggcuucgggggcgacuucaaccucacccugcuggagcccguguccaucagcaccggcucccggagcgcgcgcuccgccaucgaggaccuccuguucgacaaggugacgaucgccgacccgggguacaugcagggcuacgacgacugcaugcagcaggggcccgccagcgcccgggaccugaucugcgcgcaguacgucgccggcuacaaggugcucccgccccugauggacgugaacauggaggccgccuacaccagcucccugcucgggagcaucgcgggcgucggcuggaccgccgggcuguccagcuucgccgccauccccuucgcccaguccaucuucuaccgccugaacggcguggggaucacccagcagguccucagcgagaaccagaagcugaucgcgaacaaguucaaccaggcccugggcgccaugcagacgggguucaccaccaccaacgaggccuuccacaaggugcaggacgccgugaacaacaacgcgcaggcccucuccaagcuggccagcgagcuguccaacacguucggcgccaucagcgccuccaucggcgacaucauccagcggcucgacgugcuggagcaggacgcgcagaucgaccgccugaucaacgggcggcucaccacccugaacgccuucgucgcccagcagcuggugcgcagcgaguccgccgcgcucagcgcccagcuggccaaggacaaggugaacgagugcgucaaggcccaguccaagcggagcggcuucugcgggcagggcacccacaucguguccuucgucgugaacgcccccaacggccuguacuucaugcacgugggguacuaccccagcaaccacaucgaggucguguccgcguacggccucugcgacgccgccaaccccacgaacugcaucgccccggugaacggguacuucaucaagaccaacaacacccgcaucgucgacgaguggagcuacaccggcagcuccuucuacgcccccgagcccaucacgagccugaacaccaaguacguggcgccccaggugaccuaccagaacaucuccaccaaccugccgccgccccuccuggggaacagcaccggcaucgacuuccaggacgagcuggacgaguucuucaagaacgucuccacgagcauccccaacuucggcucccucacccagaucaacaccacccugcuggaccucacguacgagaugcugagccugcagcaggucgugaaggcccucaacgaguccuacaucgaccugaaggagcuggggaacuacaccuacuacaacaaguggcccugguacaucuggcucggcuucaucgccgggcugguggcccuggcccucugcguguucuucauccugugcugcaccggcugcgggaccaacugcaugggcaagcugaagugcaaccggugcugcgaccgcuacgaggaguacgaccucgagccccacaaggugcacguccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2378 - RNA, 2626 nt, Artificial Sequence
  mRNA product Design2 comprising derived and/or modified sequence from MERS-CoV__AHI48605__S1 (opt1) R6175/R6181
ggggcgcugccuacggagguggcagccaucuccuucucggcaucaagcuuaccaugauccacagcguguuccugcucauguuccugcugacccccaccgaguccuacgucgacgugggcccggacagcgugaaguccgccugcaucgaggucgacauccagcagacguucuucgacaagaccuggccccgccccaucgacgugagcaaggccgacgggaucaucuacccccagggccggaccuacuccaacaucaccaucacguaccagggccucuucccguaccagggggaccacggggacauguacguguacagcgcgggccacgccaccggcaccacgccccagaagcuguucgucgccaacuacucccaggacgugaagcaguucgccaacggguucgugguccgcaucggcgccgcggccaacagcaccgggaccgugaucaucucccccagcaccuccgccaccauccggaagaucuaccccgccuucaugcugggcagcuccguggggaacuucagcgacggcaagaugggccgcuucuucaaccacacgcucguccugcugccggacgggugcggcacccuccugcgggcguucuacugcauccuggagccccgcuccgggaaccacugccccgccggcaacagcuacaccuccuucgccaccuaccacacgcccgccaccgacugcagcgacggcaacuacaaccggaacgccucccucaacagcuucaaggaguacuucaaccugcgcaacugcaccuucauguacaccuacaacaucacggaggacgagauccuggagugguucgggaucacccagaccgcgcagggcgugcaccucuucagcucccgguacguggaccuguacgggggcaacauguuccaguucgccacccugccggucuacgacacgaucaaguacuacagcaucaucccccacuccauccgcagcauccaguccgaccggaaggccugggccgccuucuacguguacaagcuccagccccugaccuuccugcucgacuucagcguggacggguacauccgccgggcgaucgacugcggcuucaacgaccugucccagcugcacugcagcuacgaguccuucgacgucgagagcggcguguacuccgugagcuccuucgaggccaagcccagcggguccgucguggagcaggccgagggcguggagugcgacuucagcccgcuccuguccgggaccccgccccaggucuacaacuucaagcgccugguguucaccaacugcaacuacaaccucacgaagcugcugagccucuucuccgucaacgacuucacgugcagccagaucagccccgccgccaucgcguccaacugcuacagcucccugauccuggacuacuucagcuacccccucuccaugaaguccgaccugagcgugagcuccgccggccccaucagccaguucaacuacaagcaguccuucagcaacccgaccugccugauccucgccaccgugccccacaaccugaccaccaucaccaagccccugaaguacuccuacaucaacaagugcagccggcuccuguccgacgaccgcaccgaggucccccagcuggugaacgccaaccaguacagccccugcguguccaucguccccagcacggugugggaggacggggacuacuaccggaagcagcucagcccgcuggagggcggcggguggcugguggccuccggcagcaccgucgcgaugaccgagcagcuccagaugggguucggcaucaccgugcaguacgggaccgacacgaacuccgugugccccaagcuggaguucgccaacgacaccaagaucgccagccagcugggcaacugcgucgaguacucccucuacggcgugagcgggcgcggcguguuccagaacugcaccgccgucggggugcggcagcagcgcuucguguacgacgcguaccagaaccuggucggcuacuacuccgacgacggcaacuacuacugccugcgggccugcgugagcgugcccgucuccgugaucuacgacaaggagaccaagacgcacgccacccuguucgggagcguggccugcgagcacaucuccagcaccaugucccaguacagccgcuccacccgcagcaugcucaagcggcgcgacuccacguacggcccgcugcagacccccgucgggugcgugcugggccucgugaacagcucccuguucgucgaggacugcaagcugccccucgggcagagccugugcgcccugcccgacaccccgagcacccucacgcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
